US011447541B1

(12) United States Patent
Westendorf et al.

(10) Patent No.: US 11,447,541 B1
(45) Date of Patent: *Sep. 20, 2022

(54) ANTI-CORONAVIRUS ANTIBODIES AND METHODS OF USE

(71) Applicants: AbCellera Biologies Inc., Vancouver (CA); The United States of America, as represented by the Secretary, Department of Health and Human Svcs., Bethesda, MD (US)

(72) Inventors: Kathryn Westendorf, Vancouver (CA); Stefanie Zentelis, Vancouver (CA); Krithika Muthuraman, Toronto (CA); Kevin Jepson, Vancouver (CA); Ester Falconer, Vancouver (CA); John Mascola, Bethesda, MD (US); Barney Graham, Bethesda, MD (US); Kizzmekia Corbett, Bethesda, MD (US); Julie Ledgerwood, Bethesda, MD (US); Lingshu Wang, Bethesda, MD (US); Olubukola Abiona, Bethesda, MD (US); Wei Shi, Bethesda, MD (US); Wing-pui Kong, Bethesda, MD (US); Yi Zhang, Bethesda, MD (US); Bryan Edward Jones, San Diego, CA (US); Denisa Foster, San Diego, CA (US); Julian Davies, La Jolla, CA (US); Qing Chai, San Diego, CA (US); Christopher Carl Frye, Bargersville, IN (US); Ganapathy Gopalrathnam, Fishers, IN (US); Jörg Hendle, San Diego, CA (US); John Michael Sauder, Carlsbad, CA (US); Jeffrey Streetman Boyles, Indianapolis, IN (US); Anna Pustilnik, San Diego, CA (US)

(73) Assignees: AbCellera Biologies Inc., Vancouver (CA); The United States of America, as represented by the Secretary, Department of Health and Human Svcs., Bethesda, MD (US)

(*) Notice: Subject to any disclaimer, the term of this patent is extended or adjusted under 35 U.S.C. 154(b) by 0 days.

This patent is subject to a terminal disclaimer.

(21) Appl. No.: 17/354,476

(22) Filed: Jun. 22, 2021

Related U.S. Application Data

(63) Continuation of application No. 17/192,243, filed on Mar. 4, 2021.

(60) Provisional application No. 63/116,483, filed on Nov. 20, 2020, provisional application No. 63/085,042, filed on Sep. 29, 2020, provisional application No. 63/080,351, filed on Sep. 18, 2020, provisional application No. 63/036,089, filed on Jun. 8, 2020, provisional application No. 63/030,530, filed on May 27, 2020, provisional application No. 63/010,999, filed on Apr. 16, 2020, provisional application No. 62/987,313, filed on Mar. 9, 2020.

(51) Int. Cl.
| | |
|---|---|
| *C07K 16/10* | (2006.01) |
| *A61K 47/68* | (2017.01) |
| *A61K 39/00* | (2006.01) |
| *A61K 47/26* | (2006.01) |
| *A61K 47/18* | (2017.01) |
| *A61K 47/02* | (2006.01) |

(52) U.S. Cl.
CPC .............. *C07K 16/10* (2013.01); *A61K 47/02* (2013.01); *A61K 47/183* (2013.01); *A61K 47/26* (2013.01); *A61K 47/68* (2017.08); *A61K 2039/54* (2013.01); *A61K 2039/545* (2013.01); *C07K 2317/565* (2013.01); *C07K 2317/76* (2013.01)

(58) Field of Classification Search
None
See application file for complete search history.

(56) References Cited

U.S. PATENT DOCUMENTS 8,106,170 B2   1/2012   Ter Meulen et al.

FOREIGN PATENT DOCUMENTS

| CN | 111592595 A | 8/2020 |
|---|---|---|
| CN | 112300375 A | 2/2021 |
| KR | 1020070083768 A | 8/2007 |
| WO | 2005012360 A2 | 2/2005 |

OTHER PUBLICATIONS

Combined Search and Examination Report issued in GB App No. 2019709.1 dated Aug. 3, 2021.
Examination Report issued in EP App. No. 20213900.2 dated Sep. 22, 2021.
Hansen et al., "Supplementary Materials: Studies in humanized mice and convalescent humans yield a SARS-CoV-2 antibody cocktail", Science vol. 369, No. 6506, Jun. 15, 2020, pp. 1-30.
International Search Report and Written Opinion issued in International Application No. PCT/US2020/063991 dated Jul. 28, 2021.
International Search Report and Written Opinion issued in International Application No. PCT/US2021/020843 dated Sep. 6, 2021.

(Continued)

*Primary Examiner* — Gary B Nickol
*Assistant Examiner* — Jegatheesan Seharaseyon
(74) *Attorney, Agent, or Firm* — Potomac Law Group, PLLC

(57) ABSTRACT

Antibodies that bind SARS-CoV Spike protein, SARS-CoV-2 Spike protein, and methods of using same for treating or preventing conditions associated with SARS or COVID-19 and for detecting SARS-CoV or SARS-CoV-2.

26 Claims, 26 Drawing Sheets

Specification includes a Sequence Listing.

(56) References Cited

OTHER PUBLICATIONS

Jan Ter Meulen et al., "Human Monoclonal Antibody Combination against SARS Coronavirus: Synergy and Coverage of Escape Mutants", PLoS Medicine, 2006, vol. 3, Issue 7, e237.

Lvov D.K. et al., "Etiology of epidemic outbreaks COVID-19 on Wuhan, Hubei province, Chinese People Republic associated with 2019-nCoV (Nidovirales, Coronaviridae, Coronavirinae, Betacoronavirus, Subgenus Sarbecovirus): lessons of SARS-CoV outbreak", 2020; 65 (1).

Official Action issued in RU Application No. 2020141137 dated Jul. 16, 2021.

Pinto et al., "Cross-neutralization of SARS-CoV-2 by a human monoclonal SARS-CoV antibody", Nature, Macmillan Journals Ltd., vol. 583, No. 7815, May 18, 2020, pp. 290-295.

Westendorf et al., "LY-CoV1404 potently neutralizes SARS-CoV-2 variatns", bioRxiv, May 4, 2021, Retrieved from the Internet: URL:https://www.biorxiv.org/content/10.1101/2021.04.30.442182v3.full.pdf [retrieved on Jun. 24, 2021].

Zehua Sun et al., "Potent neutralization of SARS-CoV-2 by human antibody heavy-chain variable domains isolated from a large library with a new stable scaffold", MAbs, Jan.-Dec. 2020, 12(1).

Zheng et al., "Novel antibody epitopes dominate the antigenicity of spike glycoprotein in SARS-CoV-2 compared to SARS-CoV", Cellular & Molecular Immunology, vol. 17, 2020, pp. 536-538.

Chen et al., "SARS-CoV-2 Neutralizing Antibody LY-CoV555 in Outpatients with Covid-1911", The New England Journal of Medicine, vol. 384, No. 3, Oct. 28, 2020 (Oct. 28, 2020), pp. 229-237.

Jones et al., LY-CoV555, a rapidly isolated potent neutralizing antibody, provides protection in a non-human primate model of SARS-CoV-2 infection11, Oct. 9, 2020 (Oct. 9, 2020), Retrieved from the Internet: URL:https://www.biorxiv.org/content/10.1101/2020.09.30.318972v3.full.pdf [retrieved on May 23, 2021].

Ju et al., "Potent human neutralizing antibodies elicited by SARS-CoV-2 infection", Mar. 26, 2020 (Mar. 26, 2020), Retrieved from the Internet: URL:https://www.biorxiv.org/content/10.1101/2020.03.21.990770v2.full.pdf [retrieved on Oct. 6, 2020].

Official Action issued in RU Application No. 2020141137 dated Mar. 29, 2021.

Partial Search Report issued in EP Application No. 20213900.2 dated Jun. 4, 2021.

Wel et al., "Rapid identification of a human antibody with high prophylactic and therapeutic efficacy in three animal models of SARS-CoV-2 infection", Proceedings of the National Academy of Sciences, vol. 117, No. 47, Nov. 2, 2020 (Nov. 2, 2020), pp. 29832-29838.

Xiaolong Tan et al., "Potent binding of 2019 novel coronavirus spike protein by a SARS coronavirus-specific human monoclonal antibody", Emerging Microbes & Infections, vol. 9, No. 1, Feb. 17, 2020 (Feb. 17, 2020), pp. 382-385.

CoV3D, "Coronavirus Spike Interfaces," 2021.

Figure 6A
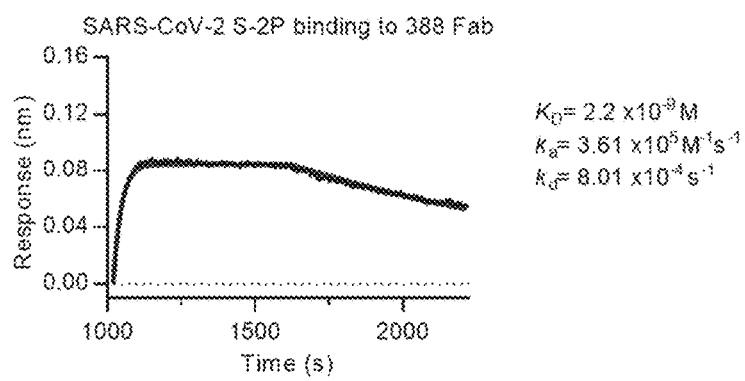
Fab388
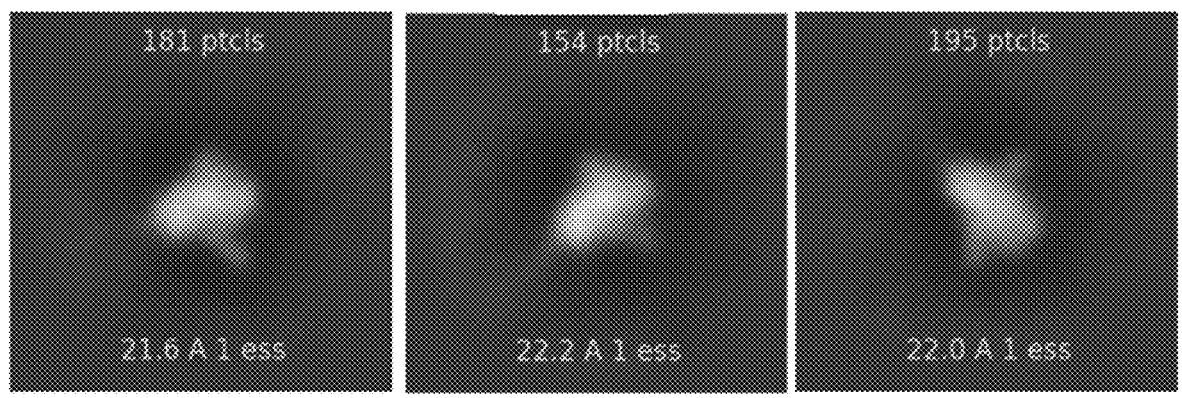
Figure 6B

Fab388

ANTI-CORONAVIRUS ANTIBODIES AND METHODS OF USE

CROSS-REFERENCE TO RELATED APPLICATIONS

The instant application is a continuation of U.S. patent application Ser. No. 17/192,243 filed 3 Mar. 2021 and claims priority to U.S. Provisional Applications Nos. 62/987,313 filed 9 Mar. 2020; 63/010,999 filed 16 Apr. 2020; 63/030,530 filed 27 May 2020; 63/036,089 filed 8 Jun. 2020; 63/080,351 filed 18 Sep. 2020; 63/085,042 filed 29 Sep. 2020; and 63/116,483 filed 20 Nov. 2020, each of which is hereby incorporated by reference in its entirety.

STATEMENT REGARDING FEDERALLY SPONSORED RESEARCH OR DEVELOPMENT

This invention was made with government support under D18AC00002 awarded by the Defense Advanced Research Projects Agency. The government has certain rights in the invention.

SEQUENCE LISTING

The instant application contains a Sequence Listing which has been submitted in ASCII format via EFS-Web and is hereby incorporated by reference in its entirety. Said ASCII copy, created on 2 Mar. 2021, is named 27050016US01030221SEQLST25.txt and is 4,791,037 bytes in size.

TECHNICAL FIELD OF THE INVENTION

This disclosure generally relates to the fields of medicine, immunology, and infectious disease. More specifically, the disclosure relates to anti-coronavirus antibodies (e.g., anti-SARS-CoV-2 antibodies) and antibody-like molecules and, in particular, to human antibodies, antibody fragments, and nucleic-acid-vectored versions thereof, and methods for treating coronavirus infections, methods for prophylaxis against coronavirus infections, and immunoassays for the detection of coronaviruses.

BACKGROUND OF THE INVENTION

Past decades have seen yearly new or reemerging viral outbreaks including Severe Acute Respiratory Syndrome coronavirus (SARS-CoV), West Nile, Ebola, Middle Eastern Respiratory Syndrome Coronavirus (MERS-CoV), Zika, and pandemic influenza. The risk of a pandemic is multiplied by growing populations and urbanization, climate change, global travel, and civil conflict. Recently, the 2019 novel coronavirus (SARS-CoV-2) outbreak has led the World Health Organization (WHO) to declare a global health emergency. These viral outbreaks have important consequences on human societies, creating a huge burden on healthcare systems and having important repercussions on the economy.

Pandemic outbreaks present a serious risk to global security and trade. For example, the 1918 H1N1 pandemic influenza virus (Spanish flu) claimed an estimated 50 million lives in a matter of months. The World Bank estimates that a pandemic to that scale would cost about 5% global gross domestic product (GDP), or about $3 trillion USD. The more recent 2009 H1N1 pandemic is estimated to have infected 11-21% of the world's population (80% under the age of 65) and claimed between 151,700 to 575,400 lives. In non-pandemic years, the WHO estimates three to five million cases of severe influenza, resulting in 250,000 to 500,000 global deaths. The propensity for rapid genetic change, antigenic diversity, and the breadth of potential hosts gives influenza type A significant pandemic potential. The rapid mutation of surface antigens allows the virus to evade the immune response, requiring an annual prediction of circulating strains to include in seasonal vaccines.

A universal flu vaccine that could provide long-term and cross-strain protection has so far been elusive, and while there are candidates in preclinical and clinical trials, it will likely be several years before one becomes available. Less predictable than seasonal drifts, genetic reassortments (antigenic shift) of hemagglutinin or neuraminidase in zoonotic hosts can generate novel strains of influenza virus that can transfer to humans and cause a fast-spreading pandemic across an immunologically naïve population. The California 2009 H1N1 strain was discovered to have originated in swine, and both the Spanish flu and Hong Kong 1957 pandemic strains are thought to have originated from an avian source. Surveillance of rapidly-shifting virulence factors in domesticated and wild zoonotic hosts is currently not possible, adding to the urgent need for a rapid response strategy to emerging influenza pandemics. The availability of a large collection of human antibodies against viral families that constitute a present or future threat would accelerate response to outbreaks by allowing for rapid identification of antibodies with properties suitable for diagnostics, prophylaxis, or therapeutics.

Pandemic Potential of Coronaviruses

Coronaviruses are a large family of viruses that infect mammals and birds, with four endemic strains that circulate commonly in humans, including human coronavirus 229E, OC43, NL63 and HKU1. These endemic strains generally cause mild flu-like symptoms, but can also cause more serious pneumonia in vulnerable populations. However, when new coronaviruses jump from zoonotic hosts (bats, birds, camels, etc.) to humans, they can result in a much more severe respiratory disease that can spread quickly through the population. Examples of such outbreaks include SARS (Severe Acute Respiratory Syndrome) in 2003, caused by SARS-associated coronavirus (SARS-CoV) which resulted in an outbreak that infected over 8,000 people worldwide and was ~10% fatal, and MERS (Middle Eastern Respiratory Syndrome) in 2012, caused by MERS-CoV, which to date has infected over 2,500 people with approximately 35% fatalities.

At the time of this application, a new coronavirus, named SARS-CoV-2, has become a serious global outbreak causing a severe respiratory disease referred to as COVID-19, and looks certain to become a global pandemic. Following the first reported cases in Wuhan, China in late 2019, there are presently over 100,000 confirmed cases globally, resulting in over 3,500 deaths. SARS-CoV-2 is now the most serious coronavirus outbreak in history. Unlike MERS-CoV and SARS-CoV, SARS-CoV-2 has spread rapidly on a global scale, with confirmed cases in more than 90 countries to date.

There have been a number of emerging SARS-CoV-2 variants. Some SARS-CoV-2 variants contain an N439K mutation, which has enhanced binding affinity to the human ACE2 receptor (Thomson, E. C., et al., "The circulating SARS-CoV-2 Spike variant N439K maintains fitness while evading antibody-mediated immunity." bioRxiv, 2020). Some SARS-CoV-2 variants contain an N501Y mutation, which is associated with increased transmissibility, including the lineages B.1.1.7 (also known as 20I/501Y.V1 and VOC 202012/01) and B.1.351 (also known as 20H/501Y.V2), which were discovered in the United Kingdom and South Africa, respectively (Tegally, H., et al., "Emergence and rapid spread of a new severe acute respiratory syndrome-related coronavirus 2 (SARS-CoV-2) lineage with multiple Spike mutations in South Africa." medRxiv, 2020: p. 2020.12.21.20248640; Leung, K., et al., "Early empirical assessment of the N501Y mutant strains of SARS-CoV-2 in the United Kingdom, October to November 2020." medRxiv, 2020: p. 2020.12.20.20248581). B.1.351 also include two other mutations in the RBD domain of SARS-CoV-2 Spike protein, K417N and E484K (Tegally, H., et al., "Emergence and rapid spread of a new severe acute respiratory syndrome-related coronavirus 2 (SARS-CoV-2) lineage with multiple Spike mutations in South Africa." medRxiv, 2020: p. 2020.12.21.20248640). Other SARS-CoV-2 variants include the Lineage B.1.1.28, which was first reported in Brazil; the Variant P.1, lineage B.1.1.28 (also known as 20J/501Y.V3), which was first reported in Japan; Variant L452R, which was first reported in California in the United States (Pan American Health Organization, Epidemiological update: Occurrence of variants of SARS-CoV-2 in the Americas, Jan. 20, 2021, available at reliefweb.int/sites/reliefweb.int/files/resources/2021-jan-20-phe-epi-update-SARS-CoV-2.pdf). Other SARS-CoV-2 variants include a SARS CoV-2 of clade 19A; SARS CoV-2 of clade 19B; a SARS CoV-2 of clade 20A; a SARS CoV-2 of clade 20B; a SARS CoV-2 of clade 20C; a SARS CoV-2 of clade 20D; a SARS CoV-2 of clade 20E (EU1); a SARS CoV-2 of clade 20F; a SARS CoV-2 of clade 20G; SARS CoV-2 B1.1.207; and other SARS CoV-2 lineages described in Rambaut, A., et al., "A dynamic nomenclature proposal for SARS-CoV-2 lineages to assist genomic epidemiology." Nat Microbiol 5, 1403-1407 (2020).

In response to this outbreak, there is an urgent need for antibody-based therapeutics, prophylactics, and diagnostics to treat, prevent, and detect the disease. Each of these applications demand antibodies with specific properties including epitope recognition, affinity, ease of manufacturing, solubility, and specificity. Furthermore, for use in therapeutic applications, human antibodies are required. The availability of a large and diverse library of human antibodies with specificity to coronaviruses would be a valuable resource for rapid response to emerging coronavirus outbreaks, allowing for the rapid screening and selection of antibodies suitable for therapeutic, prophylactic, and diagnostics uses.

Antibodies as a Countermeasure Against Viral Threats

Although vaccines are the cheapest and most effective protective countermeasures, their use is limited against viruses with high antigenic drift, antigenic shift, and against newly emerging viral strains from zoonotic hosts to which humans have little or no herd immunity. After vaccination, it takes several days post-immunization for the immune system to generate protective immunity—this is often impractical in pandemic situations where human efforts must be rapidly deployed in outbreak areas and immediate action is needed to prevent or treat infections. Passive immunization with antiviral monoclonal antibodies (mAbs) has emerged as a viable strategy to protect at-risk populations from seasonal epidemics and fast-moving pandemics.

The challenges associated with deploying such an approach at scale has prompted efforts to isolate neutralizing antibodies from convalescent patients that can be used as prophylactics or therapeutics. Several groups have shown it is feasible to discover and deliver highly potent mAbs in very short timeframes. During the 2014-2015 MERS-CoV outbreaks, two groups isolated highly potent MERS-specific mAbs, produced them recombinantly in gram quantities and tested them in animal models in a relatively short timeframe: Corti and colleagues went from immortalized B-cell screening from a single human convalescent donor to the production of prophylactically protective mAbs in four months. Pascal and colleagues identified potent fully human mAbs from immunized transgenic mice within several weeks, using both hybridoma and B-cell sorting methods. Likewise, during the 2015-2016 Ebola epidemic, several groups rapidly generated potent Ebola virus GP-specific neutralizing mAbs from memory B-cells of convalescent human donors. In all these cases, manufacturing antibody proteins in sufficient quantities for deployment at large scale was a limiting factor to generate an effective countermeasure in a timely manner.

Although multiple antiviral mAbs are in preclinical and clinical development, there is only one approved antiviral mAb on the market (palivizumab from MedImmune for respiratory syncytial virus (RSV), While mAbs have experience large success in other indications such as oncology and immune disorders, obstacles in antiviral mAb discovery largely originate from two factors: First, the relative high cost of mAb production and demanding administration protocols can make this approach difficult to apply on a global scale. Second, only a small proportion of infected individuals generate broad and potent neutralizing responses to viruses with high antigenic variability (i.e., HIV, Ebola, Lassa, and influenza). These rare mAbs generally represent a small fraction of B cells in infected individuals, which makes them very difficult to find.

The hybridoma method has historically been the main driver of antibody discovery, but it is very inefficient for finding rare mAbs. In silico display technologies overcome some of hybridoma's inefficiencies, but mAb panels discovered this way bypass nature's rigorous selection process and as a consequence often suffer from low diversity and poor developability. In fact, the recent burst in rare mAb discovery (i.e., against HIV, RSV, HMPV, Lassa, and HCMV) comes from high-throughput single B cell approaches that can directly screen patient samples. This high-throughput interrogation of natural immune-reservoirs can identify rare cross-reactive and potent mAbs, which can reduce dosing frequency and, with it, the unit cost of treatment. Molecular engineering can additionally improve both potency and cross-reactivity, and extend mAb half-life. Recent advances in nucleic acid-based mAb delivery have shown promise to decrease both costs and dosing frequencies. Clinical studies have demonstrated that administration of mRNA-encoded antibodies against Chikungunya virus could generate neutralizing titers without toxicity in human patients. These can furthermore be produced at commercial scale with high purity, and formulated to facilitate storage and shipping, which are all important factors in deploying mAbs rapidly and globally.

Pandemic Response

As part of our participation in the Pandemic Prevention Platform (P3) program of the US Defense Advanced Research Projects Agency (DARPA), we aim to build an ultra-rapid response pipeline for the discovery and delivery of field-ready therapeutic countermeasures in response to any viral outbreaks. Under P3, in a simulated pandemic scenario, we used microfluidic high-throughput single B cell screening to discover mAbs against pandemic 2009 H1N1 influenza directly from a human donor. We designed machine learning tools to automate high-confidence selection of mAbs during screening, rapidly sequenced hundreds of H1-reactive mAbs, and downselected candidates for preclinical testing using a bioinformatic pipeline and data visualization software. We developed a high-throughput and automated cloning and expression strategy to generate recombinant mAbs for neutralization assays, then administered the top neutralizers encoded as plasmid DNA (DMAbs) in a lethal challenge mouse model and showed 100% protection against a 20×LD$_{50}$ dose of pandemic H1N1 influenza virus. This demonstration of discovery to successful pre-clinical testing spanned only fifty-five days, showing that DMAbs can be effective at neutralizing pandemic viral strains in preclinical disease models, and that de novo discovery and development of therapeutic mAbs as countermeasures against a pandemic virus is possible within a rapid response timeline.

BRIEF SUMMARY OF THE INVENTION

The present disclosure relates to methods, compositions of matter, and articles of manufacture that may be used in the diagnosis, monitoring, and treatment or prevention of SARS-CoV and SARS-CoV-2-linked diseases such as COVID-19. To that end, provided herein is a large library of fully human antibodies against the Spike (S) protein of coronaviruses, e.g., SARS-CoV-2. The sequences of the heavy chain and light chain variable regions (VH and VL) of these antibodies were originally identified from a convalescent patient following infection with a coronavirus, converted to full-length human IgG1 isotype (e.g., IgG1m3 allotype), and the recombinant versions of these antibodies were subsequently produced and characterized as described herein. Therefore, these antibodies are recombinant in nature. The antibodies provided herein each binds to the Spike protein of SARS-CoV-2 virus, and some of the antibodies cross-react with the Spike protein of one or more other coronaviruses.

In one embodiment, the library is stored as a collection of electronic DNA sequences of the heavy and light chain variable regions of each member of the library. In another embodiment the library is stored as DNA molecules that encode the heavy and light chain variable regions of each member in the library. In another embodiment, the library is stored as antibody protein molecules for rapid testing. In another embodiment, the library is stored as nucleic acid-encoded versions of the antibody proteins, in mRNA or DNA formats and expression vectors suitable for direct administration to humans as nucleic acids instead of proteins.

The library of one thousand three hundred twenty nine anti-coronavirus antibodies (e.g., anti-SARS-CoV-2 antibodies) annotated by internal designations antibodies 258 to 577 and 589 to 1587 are disclosed herein and are set forth in SEQ ID NOs: 1-5316. Nucleic acids encoding the heavy chain variable regions (VH) of these antibodies are set forth in odd numbered sequences in SEQ ID NOs: 1-660, 1321-2750, and 4181-4748 detailed herein. Nucleic acids encoding the light chain variable regions (VL) of these antibodies are set forth in even numbered sequences in SEQ ID NOs: 1-660, 1321-2750, and 4181-4748 detailed herein. Amino acid sequences of the heavy chain variable regions (VH) of these antibodies are set forth in odd numbered sequences in SEQ ID NOs: 661-1320, 2751-4180, and 4749-5316 detailed herein. Amino acid sequences of the light chain variable regions of these antibodies are set forth in even numbered sequences of SEQ ID NOs: 661-1320, 2751-4180, and 4749-5316 detailed herein. As one of skill in the art will appreciate, the four sequences pertaining to any particular antibody will be separated by sequences pertaining to other antibodies. For example, the SEQ ID NOs assigned to the first antibody (designated 258) are SEQ ID NOs: 1, 2, 661 and 662 while the SEQ ID NOs assigned to the second antibody (designated 259) are SEQ ID NOs: 3, 4, 663 and 664 and so on all the way to the one thousand three hundred and twenty ninth antibody (designated 1587), which is assigned SEQ ID NOs: 4747, 4748, 5315, and 5316.

In some embodiments, the anti-coronavirus antibody (e.g., anti-SARS-CoV-2 antibody) or antigen-binding fragment thereof comprises (a) a heavy chain variable region comprising residues 31-35 for CDR-H1, residues 50-65 for CDR-H2, and residues 95-102 for CDR-H3; and (b) a light chain variable region comprising residues 24-34 for CDR-L1, residues 50-56 for CDR-L2, and residues 89-97 for CDR-L3; wherein the CDR numbering is according to Kabat.

In some embodiments, the anti-coronavirus antibody (e.g., anti-SARS-CoV-2 antibody) or antigen-binding fragment thereof comprises: (a) a heavy chain variable region comprising residues 26-32 for CDR-H1, residues 50-58 for CDR-H2, and residues 95-102 for CDR-H3; and (b) a light chain variable region comprising residues 24-34 for CDR-L1, residues 50-56 of SEQ ID NO: 62 for CDR-L2, and residues 89-97 of SEQ ID NO: 62 for CDR-L3; wherein the CDR numbering is according to Chothia.

In some embodiments, the anti-coronavirus antibody (e.g., anti-SARS-CoV-2 antibody) or antigen-binding fragment thereof comprises: (a) a heavy chain variable region comprising residues 30-35 for CDR-H1, residues 47-58 for CDR-H2, and residues 93-101 for CDR-H3; and (b) a light chain variable region comprising residues 30-36 for CDR-L1, residues 46-55 for CDR-L2, and for CDR-L3; wherein the CDR numbering is according to MacCallum.

In some embodiments, the anti-coronavirus antibody (e.g., anti-SARS-CoV-2 antibody) is defined by complete heavy and light chains. Amino acid sequences of the heavy chains of these antibodies are set forth in odd numbered SEQ ID NOs: 5319-5366, 5575-5592, and 5707-5744 and amino acid sequences of the light chains of these antibodies are set forth in odd numbered SEQ ID NOs: 5319-5366, 5575-5592, and 5707-5744.

In some embodiments, the anti-coronavirus antibody (e.g., anti-SARS-CoV-2 antibody) or antigen-binding fragment thereof comprises a heavy chain variable region having an amino acid sequence that is at least 60%, 70%, 80%, 85%, 90%, 95%, 96%, 97%, 98% or 99% identical to one of the heavy chain variable region sequences explicitly disclosed in SEQ ID NOs: 661-1320, 2751-4180, and 4749-5316 and a light chain variable region having an amino acid sequence that is at least 60%, 70%, 80%, 85%, 90%, 95%, 96%, 97%, 98% or 99% identical to one of the light chain variable region sequences explicitly disclosed in SEQ ID NOs: 661-1320, 2751-4180, and 4749-5316.

In some embodiments, members of the antibody library are specific to SARS-CoV-2. In some embodiments, the antibodies are known to cross-react against SARS-CoV and SARS-CoV-2 Spike proteins. In some embodiments, the antibodies are specific to SARS-CoV Spike protein.

In some embodiments, the anti-coronavirus antibody (e.g., anti-SARS-CoV-2 antibody) or antigen-binding fragment thereof is a neutralizing antibody. In other embodiments, the antibody or antigen-binding fragment thereof is a depleting antibody.

In some embodiments, the antibody or antigen-binding fragment thereof comprises at least one amino acid substitution. In particular embodiments, the at least one amino acid substitution is a conservative substitution. In some embodiments, the at least one amino acid substitution is a substitution of an amino acid for a non-genetically encoded amino acid or a synthetic amino acid.

In some embodiments, the antibody or antigen-binding fragment thereof is conjugated to an immunomodulator, a cytokine, a cytotoxic agent, a chemotherapeutic agent, a diagnostic agent, an antiviral agent, an antimicrobial agent, or a drug.

In some embodiments, the antibody or antigen-binding fragment thereof is formulated as a pharmaceutical composition. In some embodiments, the pharmaceutical composition may comprise one or more pharmaceutically acceptable carriers, diluents, or excipients. In particular embodiments, the antibody or antigen-binding fragment thereof may be conjugated to an immunomodulator, a cytokine, a cytotoxic agent, a chemotherapeutic agent, a diagnostic agent, an antiviral agent, an antimicrobial agent, or a drug prior to formulation.

The inventions disclosed herein also encompass isolated nucleic acids encoding part or all of the anti-coronavirus antibodies (e.g., anti-SARS-CoV-2 antibodies) and antigen-binding fragments thereof disclosed herein. In some embodiments, the foregoing nucleic acids may be incorporated into a vector. In some embodiments, the foregoing nucleic acids may be incorporated into a host cell or a vector then into a host cell.

The inventions disclosed herein also encompass methods of identifying a SARS-CoV-2-infected cell comprising contacting a cell with an anti-coronavirus antibody (e.g., anti-SARS-CoV-2 antibody) or antigen-binding fragment thereof conjugated to a detectable agent and detecting specific binding of the antibody or antigen-binding fragment thereof to the cell.

The inventions disclosed herein also encompass methods of using an anti-coronavirus antibody (e.g., anti-SARS-CoV-2 antibody) or antigen-binding fragment thereof as a test reagent for the development and production of a vaccine (e.g., an inactivated virus) against a SARS-CoV-2 disease (such as COVID-19).

The inventions disclosed herein also encompass methods of diagnosing a SARS-CoV-2 infection in a patient comprising contacting a sample obtained from a patient with a SARS-CoV-2 antibody or antigen-binding fragment thereof conjugated to a detectable agent and detecting specific binding of the antibody or antigen-binding fragment thereof to a SARS-CoV-2 antigen present in the sample.

The inventions disclosed herein also encompass methods of treating a SARS-CoV-linked disease (SARS) or SARS-CoV-2-linked disease (such as COVID-19) comprising administering to a patient a therapeutically effective amount of a SARS-CoV-2 antibody or antigen-binding fragment thereof. Prior to administration, the antibody or antigen-binding fragment thereof may be conjugated (for example, to an anti-viral agent) or formulated as a pharmaceutical composition.

The inventions disclosed herein also encompass articles of manufacture useful for diagnosing or treating a SARS-CoV-2-linked disease comprising a receptacle comprising a SARS-CoV-2 antibody or antigen-binding fragment thereof, or antibody conjugate, or pharmaceutical composition as well as instructional materials for using the same to treat or diagnose the SARS-CoV-2-linked disease.

The inventions disclosed herein also encompass processes for producing a SARS-CoV-2 antibody comprising cultivating a host cell under conditions such that the antibody is expressed and recovering the expressed antibody.

The foregoing is a summary and thus contains, by necessity, simplifications, generalizations, and omissions of detail; consequently, those skilled in the art will appreciate that the summary is illustrative only and is not intended to be in any way limiting. Other aspects, features, and advantages of the methods, compositions and/or devices and/or other subject matter described herein will become apparent in the teachings set forth herein. The summary is provided to introduce a selection of concepts in a simplified form that are further described below in the Detailed Description. This summary is not intended to identify key features or essential features of the claimed subject matter, nor is it intended to be used as an aid in determining the scope of the claimed subject matter.

BRIEF DESCRIPTION OF THE SEVERAL VIEWS OF THE DRAWINGS

Figure 1A:
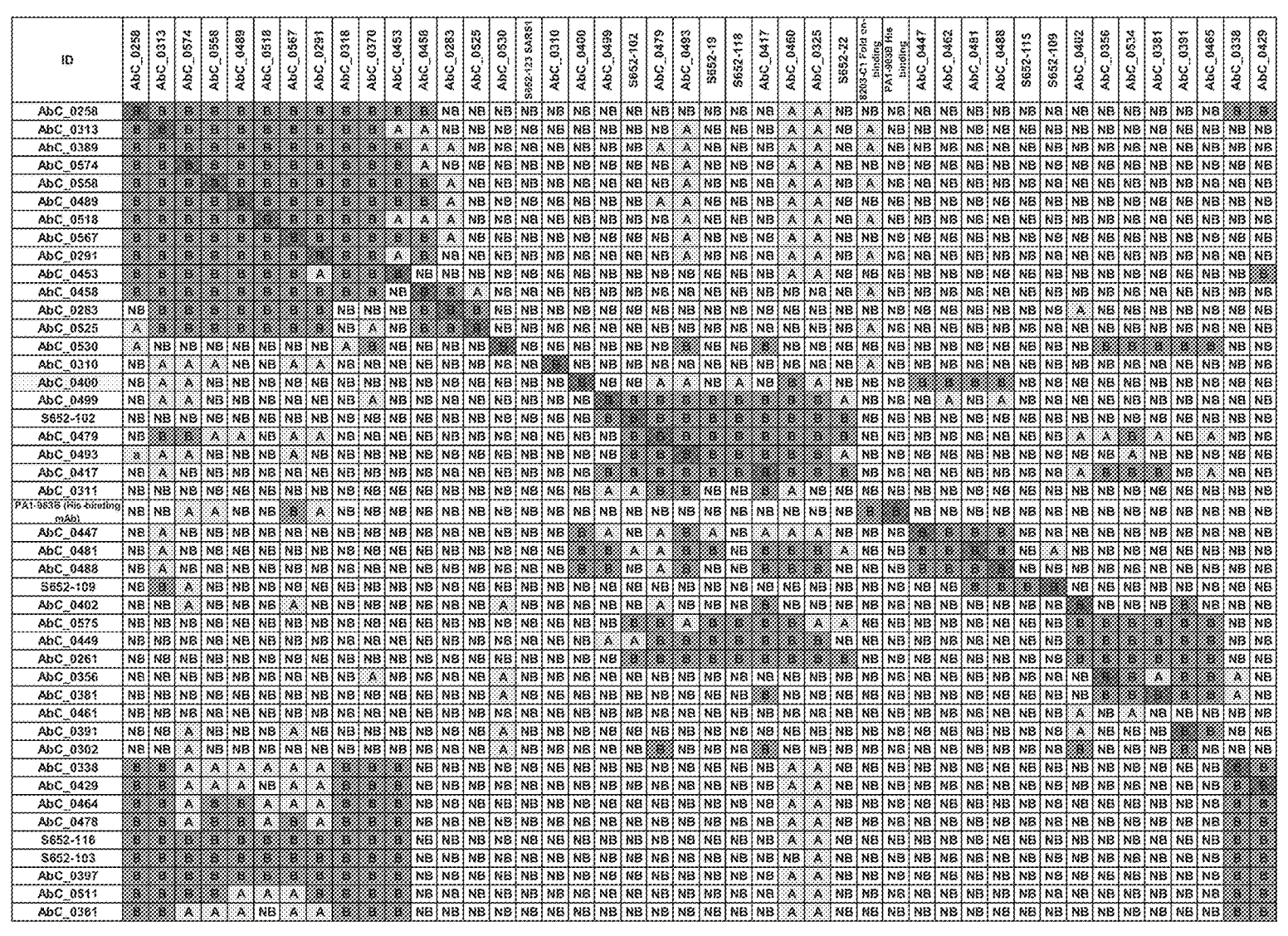
Figure 1B:
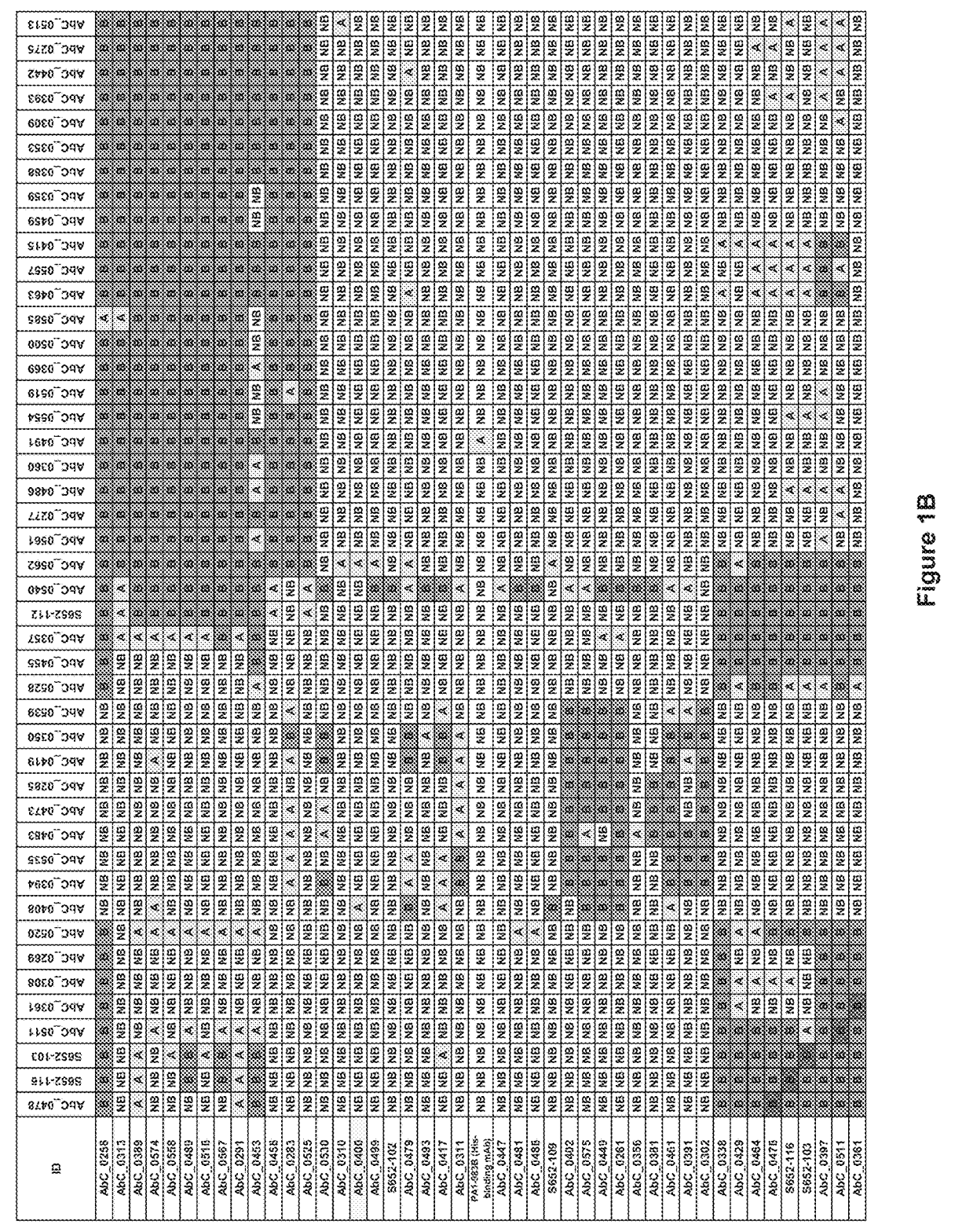
Figure 1C:
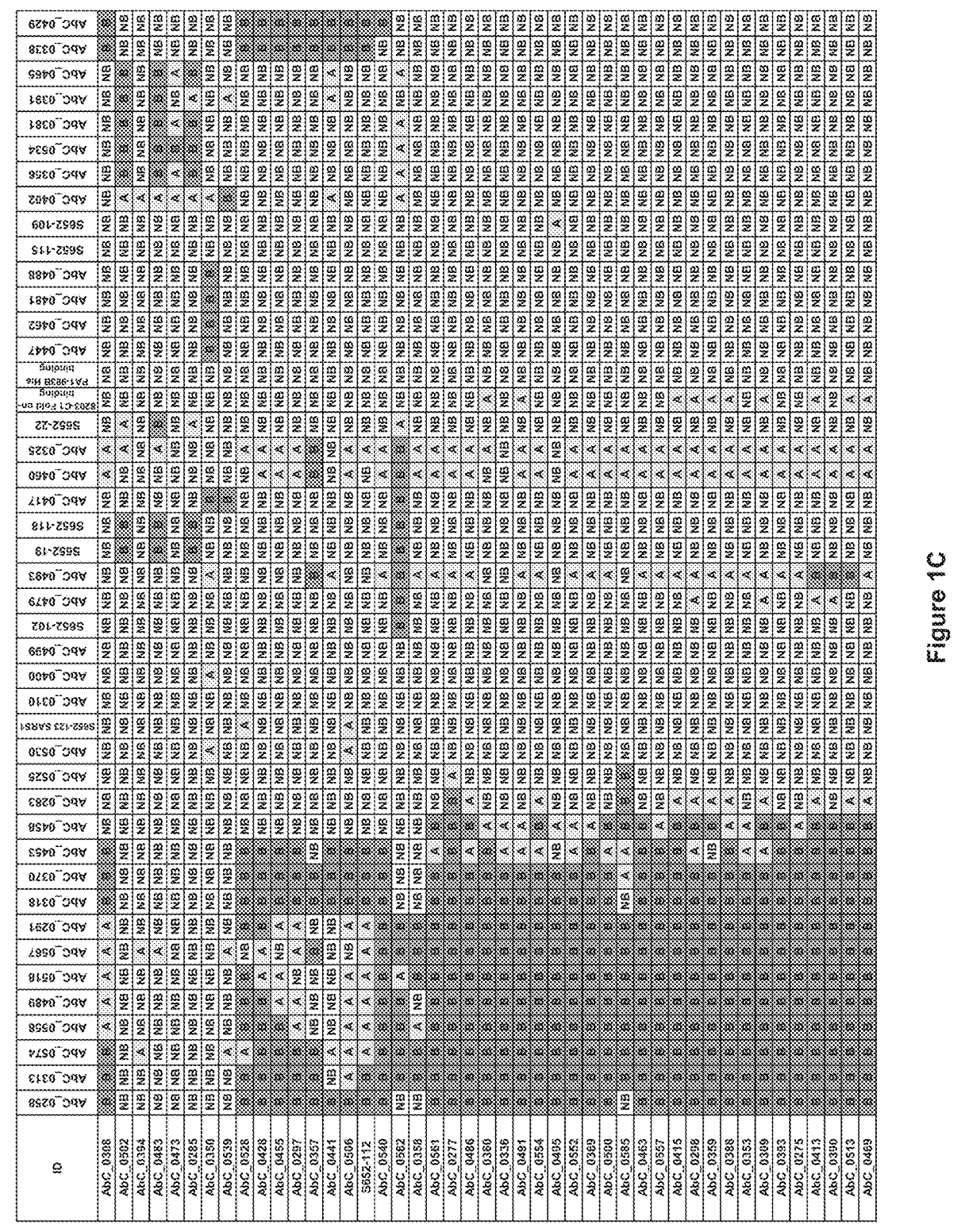
Figure 1D:
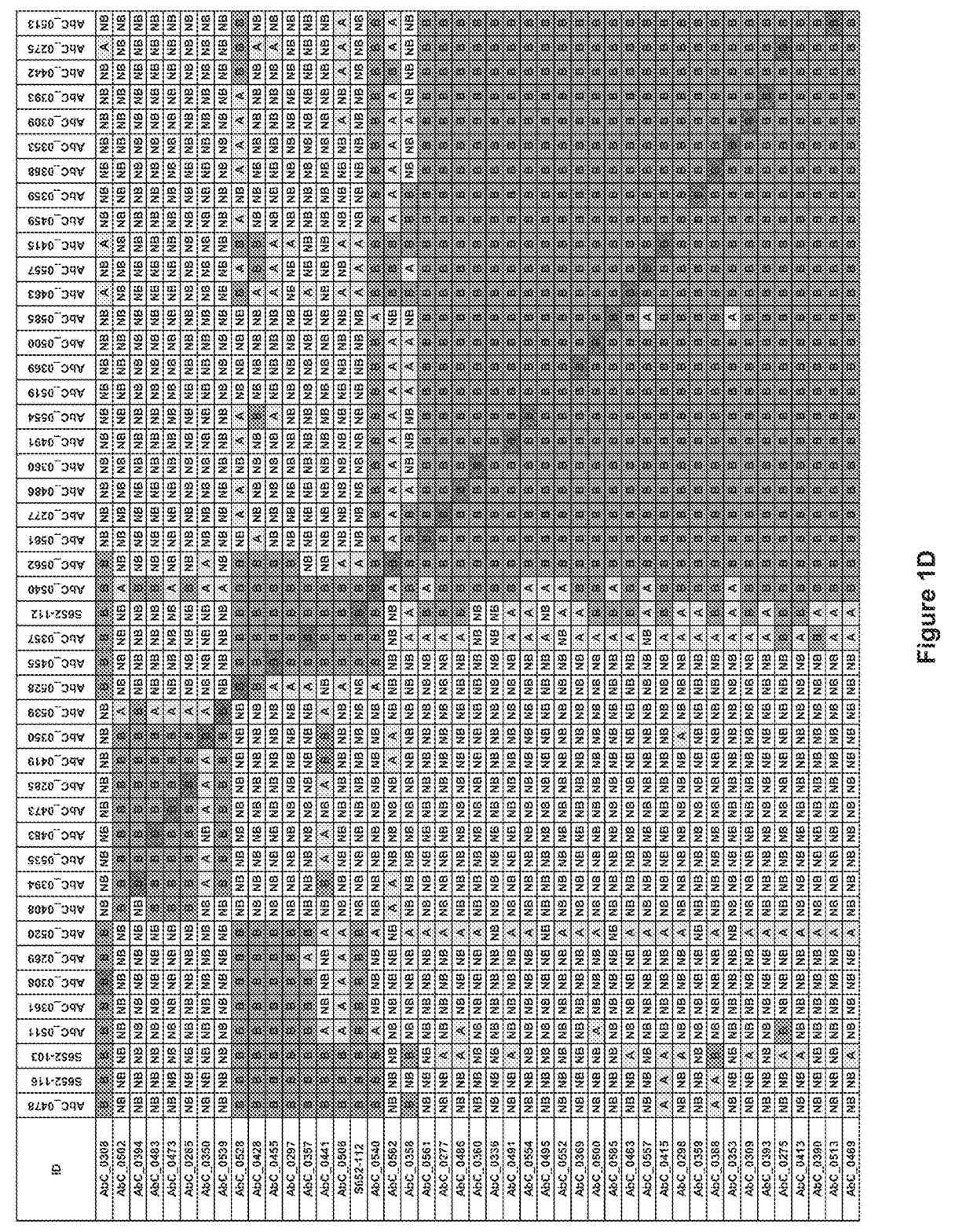

FIGS. 1A-1D show a heat map generated from epitope binning experiments using CARTERRA® Epitope analysis software. Binding signals were normalized to the Ag-only signal average equivalent to one RU (relative unit). A threshold window (0.9 RU to 1.1 RU) was used to classify analytes into 3 categories, i.e., blockers (analytes with a binding signal under the lower limit threshold), sandwichers (analytes with a binding signal over the higher limit threshold) and ambiguous (analytes with a signal falling between the lower and higher limit thresholds). The software automatically clusters like-behaved mAbs into a heat map. B=Blockers (2 mAbs that block each other and likely compete for the same epitope; medium gray). NB=Non-blockers (2 mAbs that do not block each other and likely bind 2 different epitopes, or "sandwich"; white). A=Ambiguous (light gray). Self-vs-self interaction is highlighted in dark gray.

FIG. 6A shows the binding kinetics curve of Fab 388 to SARS-CoV-2 Spike protein. FIG. 6B shows representative negative stain electron microscopy images of Fab 388 in complex with the trimeric SARS-CoV-2 Spike protein.

FIGS. 10A-10F: Values represent the mean and standard error of the mean for 3 or 4 animals. FIGS. 10G and 10H: bars represent the mean of 3 or 4 animals. Samples below the lower limit of quantification (LLOQ) were designated a value of ½ LLOQ. LLOQ=50 copies for genomes or sg mRNA.

DETAILED DESCRIPTION OF THE INVENTION

Figure 2A:
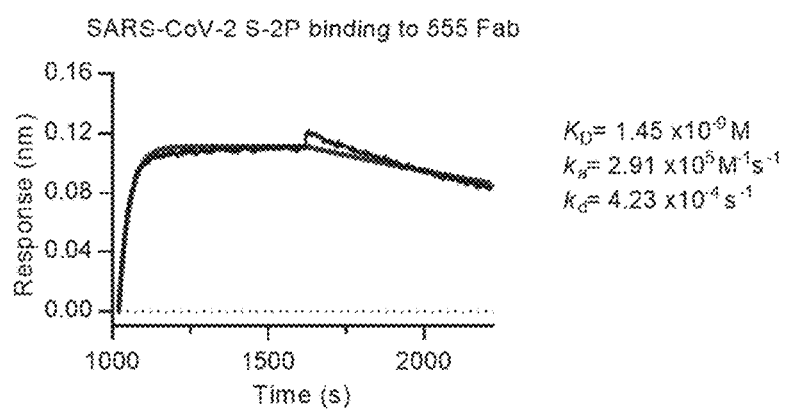
FIG. 2A shows the binding kinetics curve of Fab 555 to SARS-CoV-2 Spike protein.
Figure 2B:
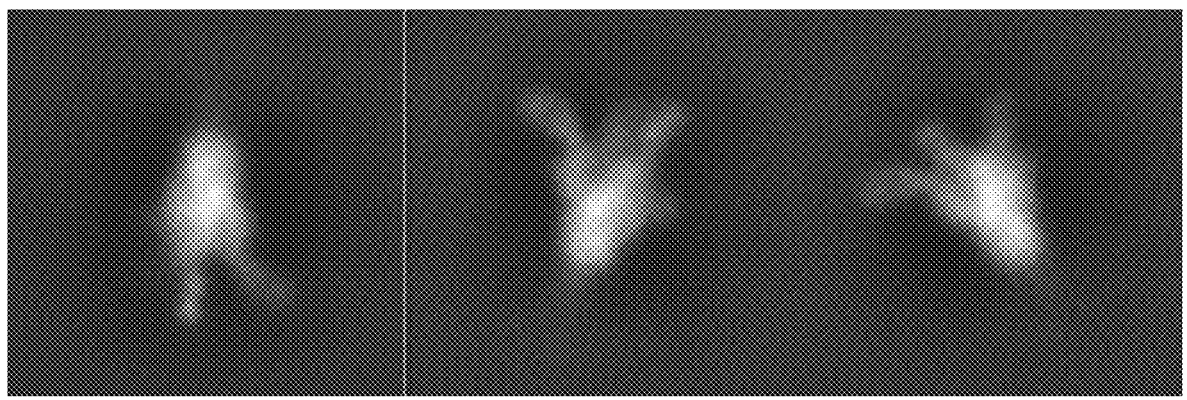
FIG. 2B shows representative negative stain electron microscopy images of Fab 555 in complex with the trimeric SARS-CoV-2 Spike protein.
Figure 2C:
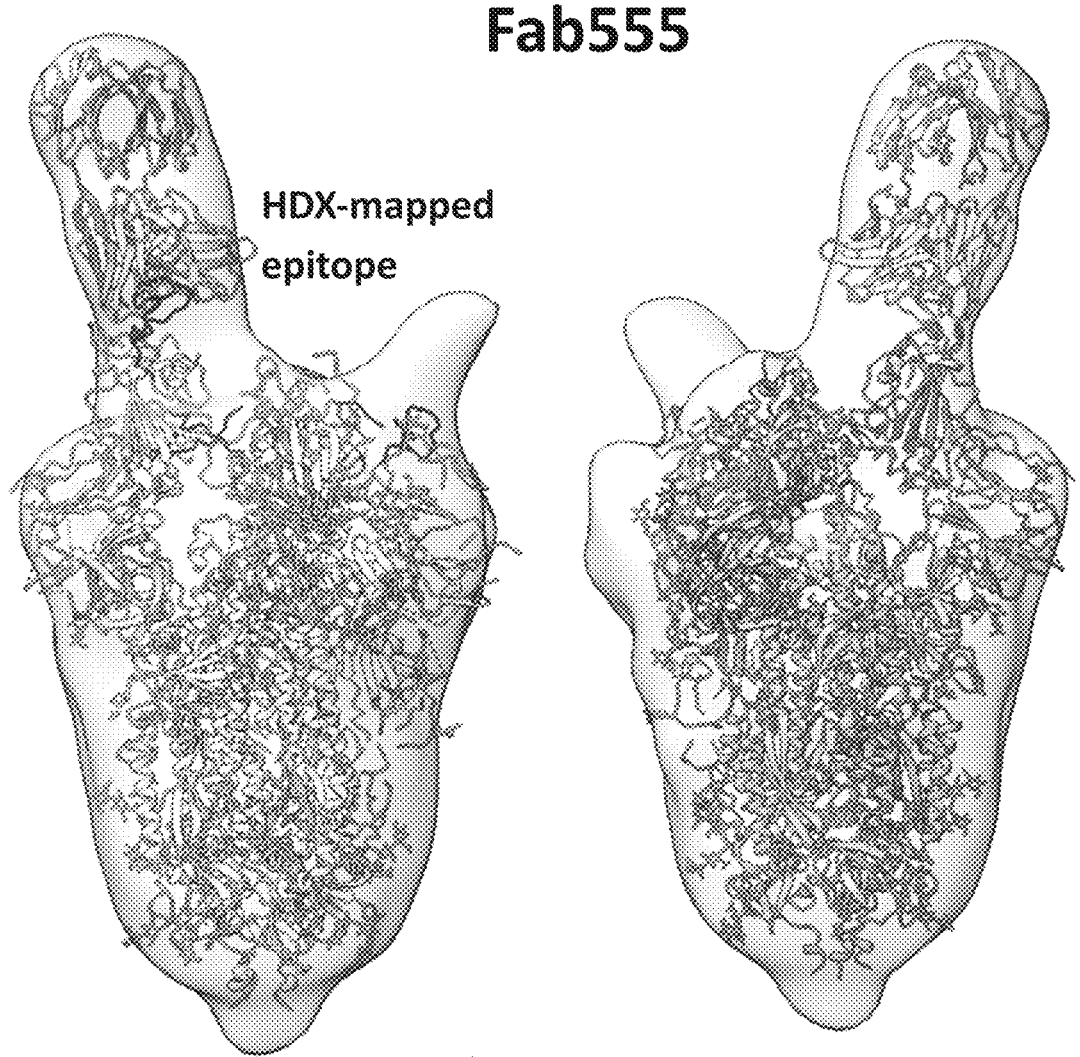
FIG. 2C shows a three-dimensional reconstruction of the complex of Fab 555 and SARS-CoV-2 Spike protein within the class-averaged image density; with the peptide regions corresponding to the epitope information derived from HDXMS experiments labeled dark grey.
Figure 3A:
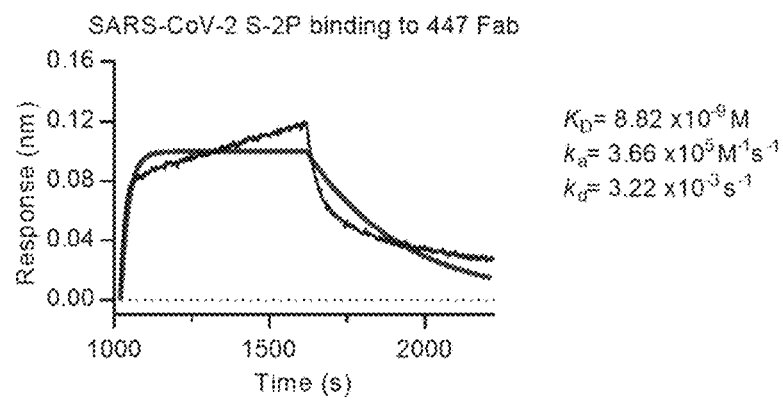
FIG. 3A shows the binding kinetics curve of Fab 447 to SARS-CoV-2 Spike protein.
Figure 3B:
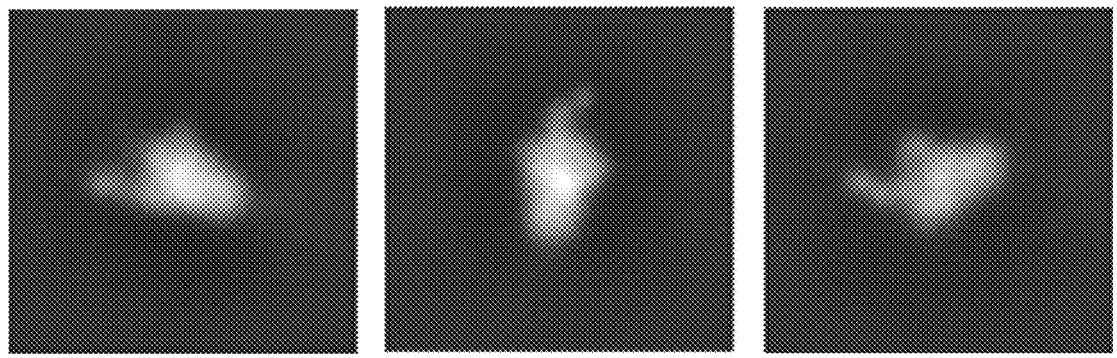
FIG. 3B shows representative negative stain electron microscopy images of Fab 447 in complex with the trimeric SARS-CoV-2 Spike protein.
Figure 3C:
FIG. 3C shows a three-dimensional reconstruction of the complex of Fab 447 and SARS-CoV-2 Spike protein within the class-averaged image density.
Figure 4A:
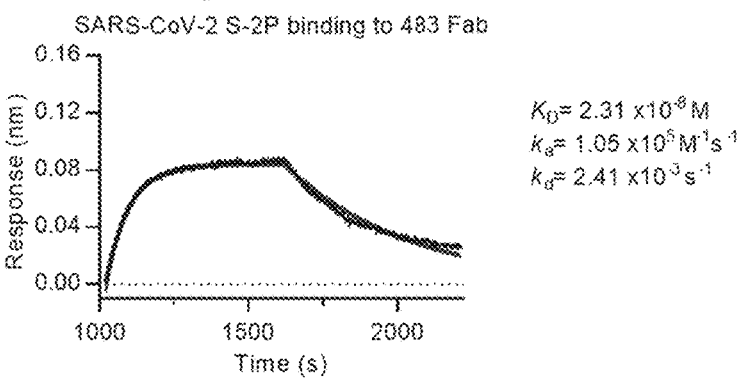
FIG. 4A shows the binding kinetics curve of Fab 483 to SARS-CoV-2 Spike protein.
Figure 4B:
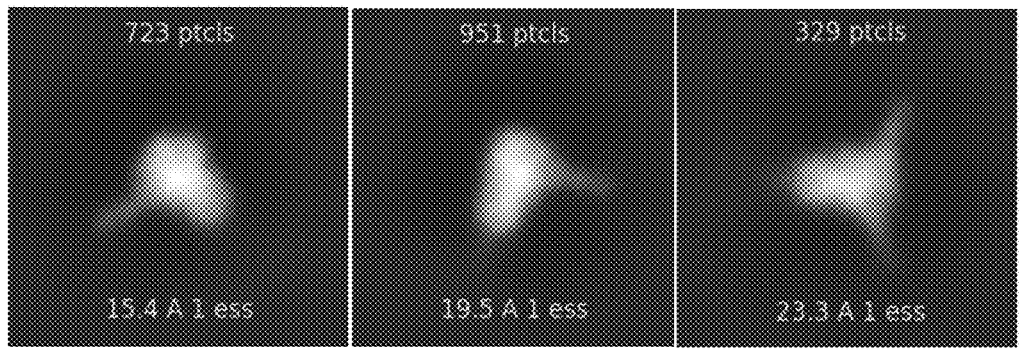
FIG. 4B shows representative negative stain electron microscopy images of Fab 483 in complex with the trimeric SARS-CoV-2 Spike protein.
Figure 4C:
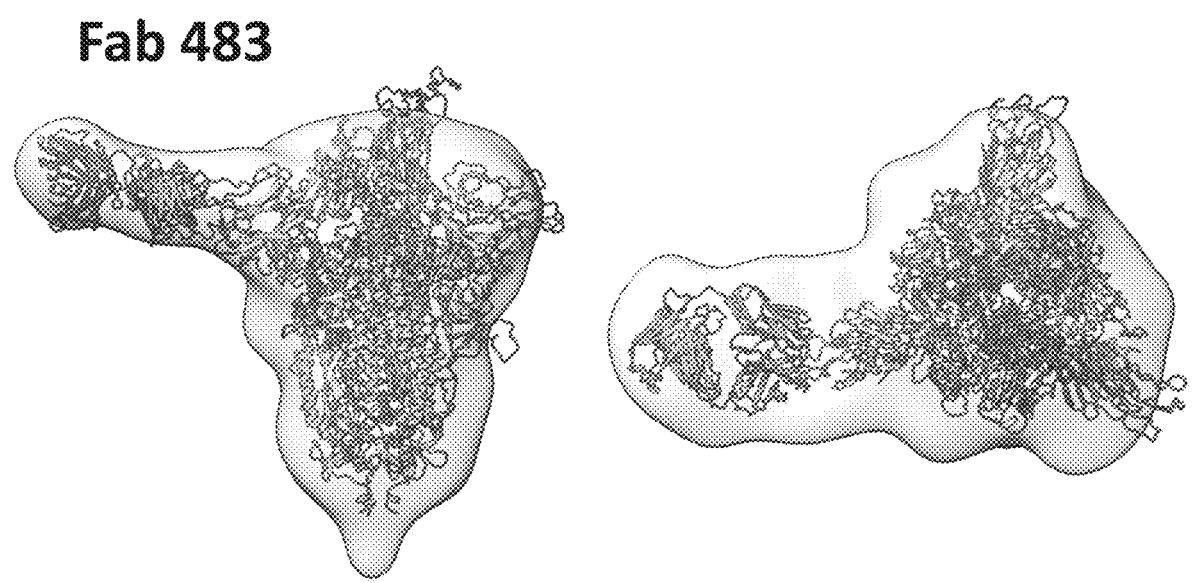
FIG. 4C shows a three-dimensional reconstruction of the complex of Fab 483 and SARS-CoV-2 Spike protein within the class-averaged image density.
Figure 5A:
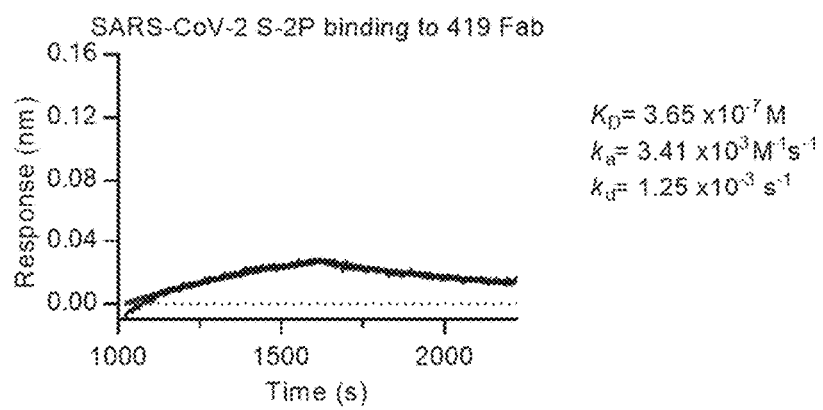
FIG. 5A shows the binding kinetics curve of Fab 419 to SARS-CoV-2 Spike protein.
Figure 5B:
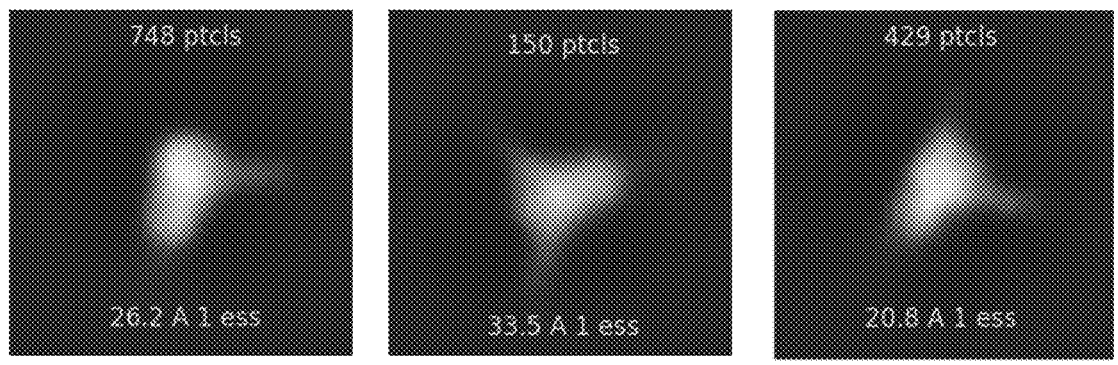
FIG. 5B shows representative negative stain electron microscopy images of Fab 419 in complex with the trimeric SARS-CoV-2 Spike protein.
Figure 5C:
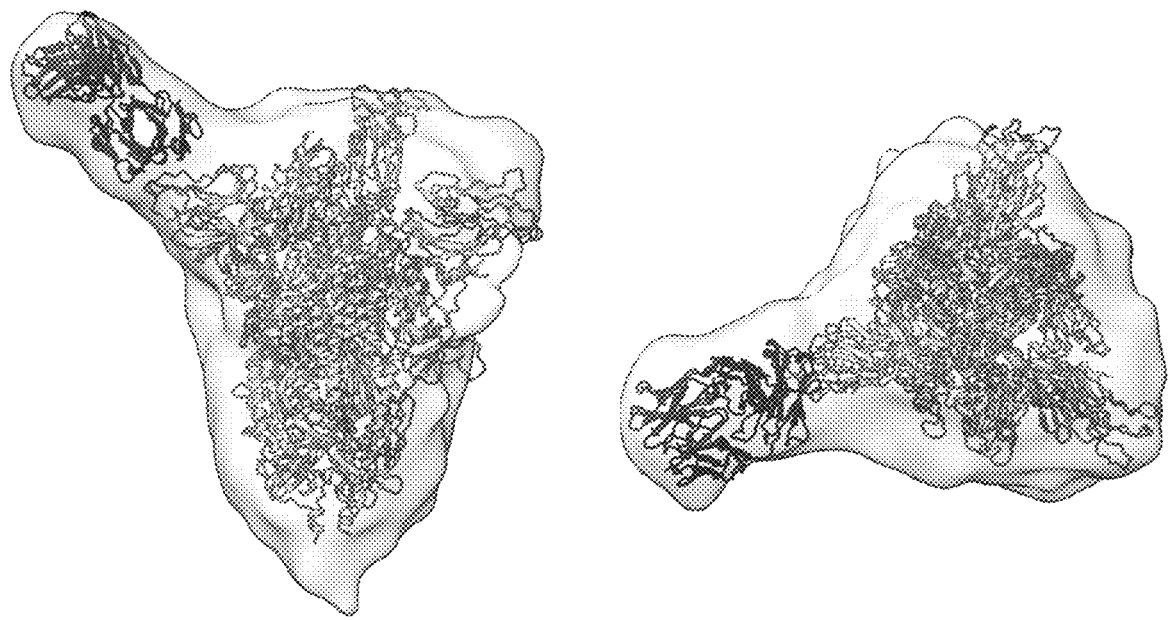
FIG. 5C shows a three-dimensional reconstruction of the complex of Fab 419 and SARS-CoV-2 Spike protein within the class-averaged image density.
Figure 6C:
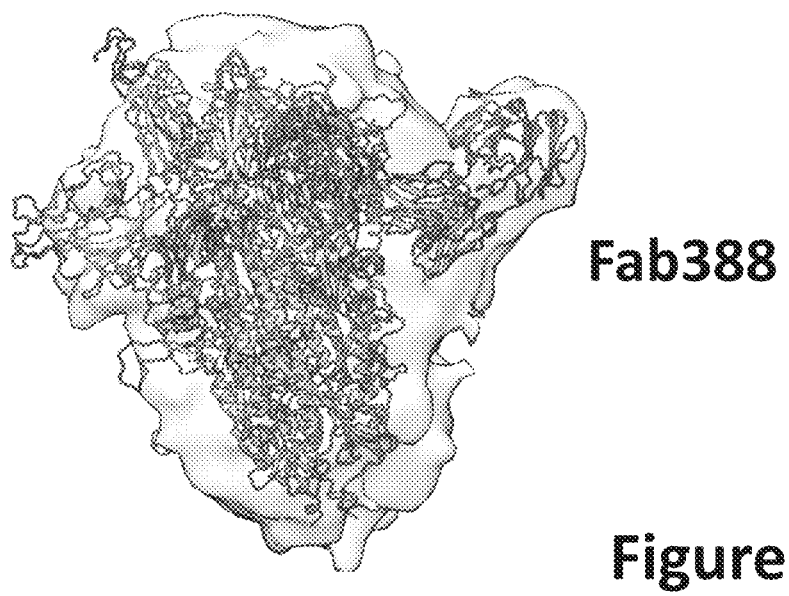
FIG. 6C shows a three-dimensional reconstruction of the complex of Fab 388 and SARS-CoV-2 Spike protein within the class-averaged image density.
Figure 6C:
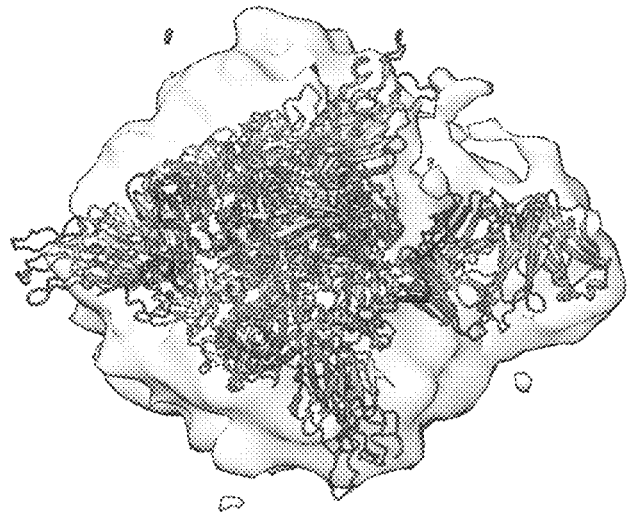
Figure 7:
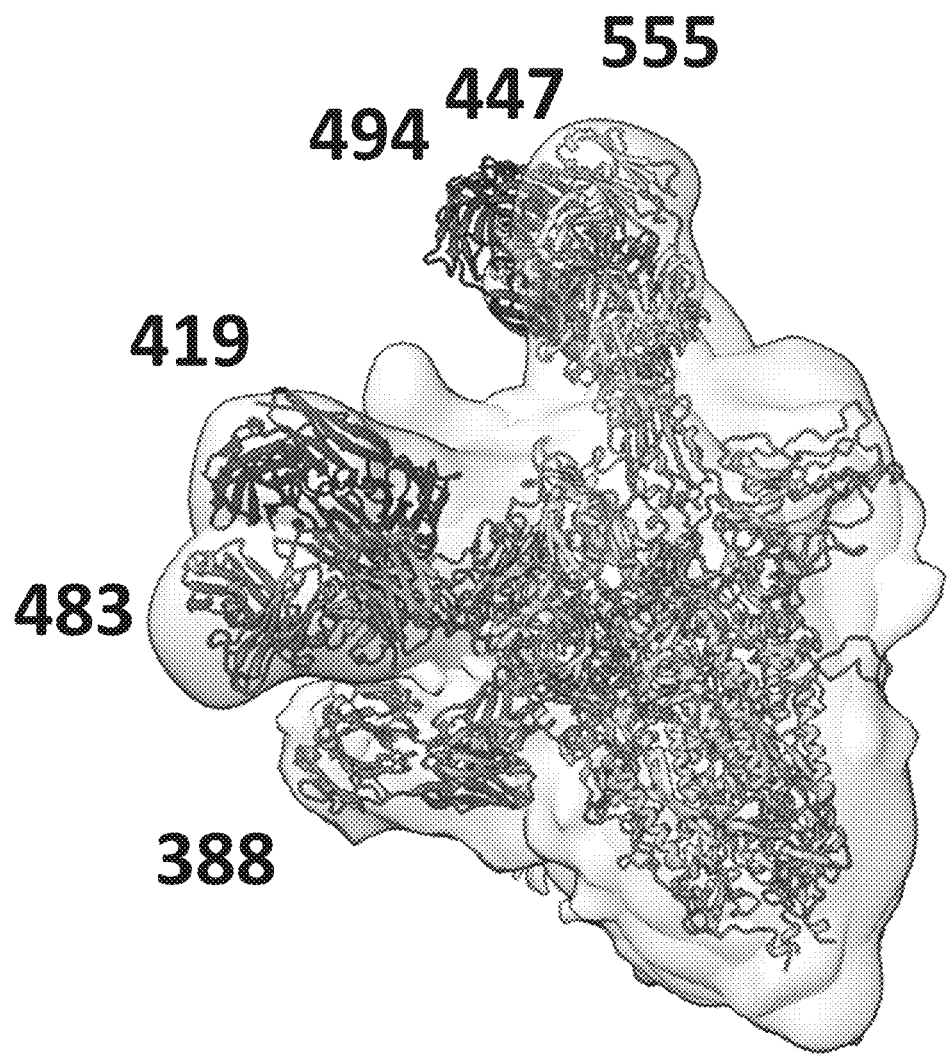
FIG. 7 shows the relative binding site of Fabs 555, 447, 483, 419, 388 on SARS-CoV-2 Spike protein.
Figure 8A:
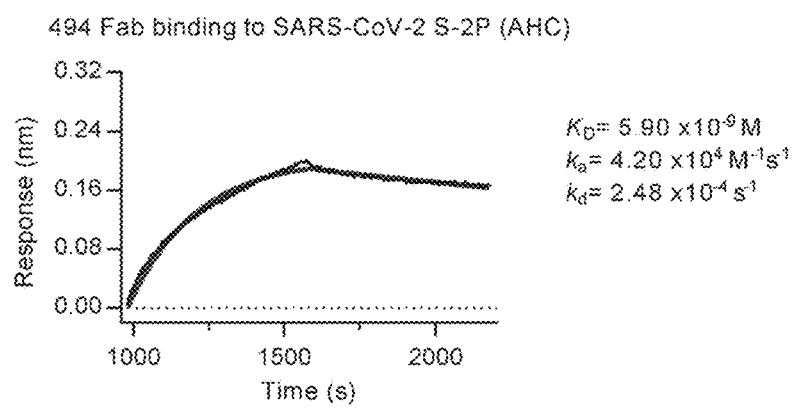
FIG. 8A shows the binding kinetics curve of Fab 494 to SARS-CoV-2 Spike protein.
Figure 8B:
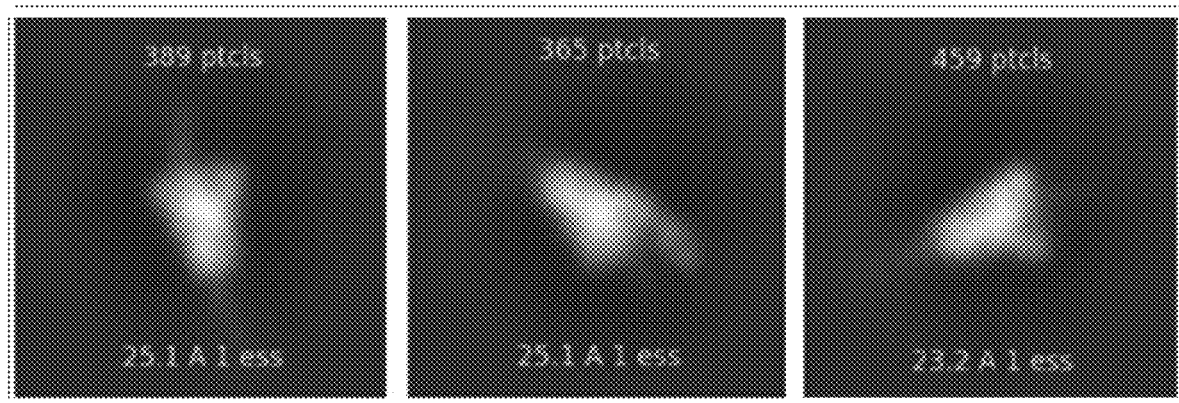
FIG. 8B shows representative negative stain electron microscopy images of Fab 494 in complex with the trimeric SARS-CoV-2 Spike protein.
Figure 8C:
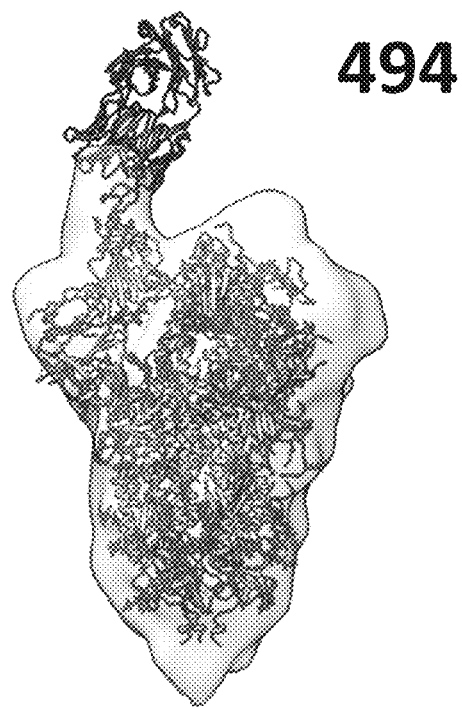
FIG. 8C shows a three-dimensional reconstruction of the complex of Fab 494 and SARS-CoV-2 Spike protein within the class-averaged image density.

While the present invention may be embodied in many different forms, disclosed herein are specific illustrative embodiments thereof that exemplify the principles of the invention. It should be emphasized that the present invention is not limited to the specific embodiments illustrated. Moreover, any section headings used herein are for organizational purposes only and are not to be construed as limiting the subject matter described.

Unless otherwise defined herein, scientific, and technical terms used in connection with the present invention shall have the meanings that are commonly understood by those of ordinary skill in the art. Further, unless otherwise required by context, singular terms shall include pluralities and plural terms shall include the singular. More specifically, as used in this specification and the appended claims, the singular forms "a," "an" and "the" include plural referents unless the context clearly dictates otherwise. Thus, for example, reference to "a protein" includes a plurality of proteins; reference to "a cell" includes mixtures of cells, and the like. In addition, ranges provided in the specification and appended claims include both end points and all points between the end points. Therefore, a range of 2.0 to 3.0 includes 2.0, 3.0, and all points between 2.0 and 3.0.

Generally, nomenclature used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The nomenclature used in connection with, and the laboratory procedures and techniques of, analytical chemistry, synthetic organic chemistry, and medicinal and pharmaceutical chemistry described herein are those well-known and commonly used in the art.

Exemplary Embodiments of the Invention

In particular embodiments, the inventions disclosed herein encompass an antibody or antigen-binding fragment thereof that specifically binds to a SARS-CoV-2 antigen, SARS-CoV-2 viral particle, or SARS-CoV-2-infected cell, wherein the antibody or antigen-binding fragment thereof comprises:

(a) three CDRs of a heavy chain variable region set forth as SEQ ID NO: 661 and three CDRs of a light chain variable region set forth as SEQ ID NO: 662; or (b) three CDRs of a heavy chain variable region set forth as SEQ ID NO: 663 and three CDRs of a light chain variable region set forth as SEQ ID NO: 664; or (c) three CDRs of a heavy chain variable region set forth as SEQ ID NO: 665 and three CDRs of a light chain variable region set forth as SEQ ID NO: 666; or (d) three CDRs of a heavy chain variable region set forth as SEQ ID NO: 667 and three CDRs of a light chain variable region set forth as SEQ ID NO: 668; or (e) three CDRs of a heavy chain variable region set forth as SEQ ID NO: 669 and three CDRs of a light chain variable region set forth as SEQ ID NO: 670; or (f) three CDRs of a heavy chain variable region set forth as SEQ ID NO: 671 and three CDRs of a light chain variable region set forth as SEQ ID NO: 672; or (g) three CDRs of a heavy chain variable region set forth as SEQ ID NO: 673 and three CDRs of a light chain variable region set forth as SEQ ID NO: 674; or (h) three CDRs of a heavy chain variable region set forth as SEQ ID NO: 675 and three CDRs of a light chain variable region set forth as SEQ ID NO: 676; or (i) three CDRs of a heavy chain variable region set forth as SEQ ID NO:677 and three CDRs of a light chain variable region set forth as SEQ ID NO: 678; or (j) three CDRs of a heavy chain variable region set forth as SEQ ID NO: 679 and three CDRs of a light chain variable region set forth as SEQ ID NO: 680; or (k) three CDRs of a heavy chain variable region set forth as SEQ ID NO: 681 and three CDRs of a light chain variable region set forth as SEQ ID NO: 682; or (l) three CDRs of a heavy chain variable region set forth as SEQ ID NO: 683 and three CDRs of a light chain variable region set forth as SEQ ID NO: 684; or (m) three CDRs of a heavy chain variable region set forth as SEQ ID NO: 685 and three CDRs of a light chain variable region set forth as SEQ ID NO: 686; or (n) three CDRs of a heavy chain variable region set forth as SEQ ID NO: 687 and three CDRs of a light chain variable region set forth as SEQ ID NO: 688; or (o) three CDRs of a heavy chain variable region set forth as SEQ ID NO: 689 and three CDRs of a light chain variable region set forth as SEQ ID NO: 670; or (p) three CDRs of a heavy chain variable region set forth as SEQ ID NO: 671 and three CDRs of a light chain variable region set forth as SEQ ID NO: 672; or (q) three CDRs of a heavy chain variable region set forth as SEQ ID NO: 673 and three CDRs of a light chain variable region set forth as SEQ ID NO: 674; or (r) three CDRs of a heavy chain variable region set forth as SEQ ID NO: 675 and three CDRs of a light chain variable region set forth as SEQ ID NO: 676; or (s) three CDRs of a heavy chain variable region set forth as SEQ ID NO: 677 and three CDRs of a light chain variable region set forth as SEQ ID NO: 678; or (t) three CDRs of a heavy chain variable region set forth as SEQ ID NO: 679 and three CDRs of a light chain variable region set forth as SEQ ID NO: 680; or (u) three CDRs of a heavy chain variable region set forth as SEQ ID NO: 681 and three CDRs of a light chain variable region set forth as SEQ ID NO: 682; or (v) three CDRs of a heavy chain variable region set forth as SEQ ID NO: 683 and three CDRs of a light chain variable region set forth as SEQ ID NO: 684; or (w) three CDRs of a heavy chain variable region set forth as SEQ ID NO: 685 and three CDRs of a light chain variable region set forth as SEQ ID NO: 686; or (x) three CDRs of a heavy chain variable region set forth as SEQ ID NO: 687 and three CDRs of a light chain variable region set forth as SEQ ID NO: 688; or (y) three CDRs of a heavy chain variable region set forth as SEQ ID NO: 689 and three CDRs of a light chain variable region set forth as SEQ ID NO: 690; or (z) three CDRs of a heavy chain variable region set forth as SEQ ID NO: 691 and three CDRs of a light chain variable region set forth as SEQ ID NO: 692; or (a-i) three CDRs of a heavy chain variable region set forth as SEQ ID NO: 693 and three CDRs of a light chain variable region set forth as SEQ ID NO: 694; or (b-i) three CDRs of a heavy chain variable region set forth as SEQ ID NO: 695 and three CDRs of a light chain variable region set forth as SEQ ID NO: 696; or (c-i) three CDRs of a heavy chain variable region set forth as SEQ ID NO: 697 and three CDRs of a light chain variable region set forth as SEQ ID NO: 698; or (d-i) three CDRs of a heavy chain variable region set forth as SEQ ID NO: 699 and three CDRs of a light chain variable region set forth as SEQ ID NO: 700; or (e-i) three CDRs of a heavy chain variable region set forth as SEQ ID NO: 701 and three CDRs of a light chain variable region set forth as SEQ ID NO: 702; or (f-i) three CDRs of a heavy chain variable region set forth as SEQ ID NO: 703 and three CDRs of a light chain variable region set forth as SEQ ID NO: 704; or (g-i) three CDRs of a heavy chain variable region set forth as SEQ ID NO: 705 and three CDRs of a light chain variable region set forth as SEQ ID NO: 706; or (h-i) three CDRs of a heavy chain variable region set forth as SEQ ID NO: 707 and three CDRs of a light chain variable region set forth as SEQ ID NO: 708; or (i-i) three CDRs of a heavy chain variable region set forth as SEQ ID NO: 709 and three CDRs of a light chain variable region set forth as SEQ ID NO: 710; or (j-i) three CDRs of a heavy chain variable region set forth as SEQ ID NO: 711 and three CDRs of a light chain variable region set forth as SEQ ID NO: 712; or (k-i) three CDRs of a heavy chain variable region set forth as SEQ ID NO: 713 and three CDRs of a light chain variable region set forth as SEQ ID NO: 714; or (l-i) three CDRs of a heavy chain variable region set forth as SEQ ID NO: 715 and three CDRs of a light chain variable region set forth as SEQ ID NO: 716; or (m-i) three CDRs of a heavy chain variable region set forth as SEQ ID NO: 717 and three CDRs of a light chain variable region set forth as SEQ ID NO: 718; or (n-i) three CDRs of a heavy chain variable region set forth as SEQ ID NO: 719 and three CDRs of a light chain variable region set forth as SEQ ID NO: 720; or (o-i) three CDRs of a heavy chain variable region set forth as SEQ ID NO: 721 and three CDRs of a light chain variable region set forth as SEQ ID NO: 722; or (p-i) three CDRs of a heavy chain variable region set forth as SEQ ID NO: 723 and three CDRs of a light chain variable region set forth as SEQ ID NO: 724; or (q-i) three CDRs of a heavy chain variable region set forth as SEQ ID NO: 725 and three CDRs of a light chain variable region set forth as SEQ ID NO: 726; or (r-i) three CDRs of a heavy chain variable region set forth as SEQ ID NO: 727 and three CDRs of a light chain variable region set forth as SEQ ID NO: 728; or (s-i) three CDRs of a heavy chain variable region set forth as SEQ ID NO: 729 and three CDRs of a light chain variable region set forth as SEQ ID NO: 730; or (t-i) three CDRs of a heavy chain variable region set forth as SEQ ID NO: 731 and three CDRs of a light chain variable region set forth as SEQ ID NO: 732; or (u-i) three CDRs of a heavy chain variable region set forth as SEQ ID NO: 733 and three CDRs of a light chain variable region set forth as SEQ ID NO: 734; or (v-i) three CDRs of a heavy chain variable region set forth as SEQ ID NO: 735 and three CDRs of a light chain variable region set forth as SEQ ID NO: 736; or (w-i) three CDRs of a heavy chain variable region set forth as SEQ ID NO: 737 and three CDRs of a light chain variable region set forth as SEQ ID NO: 738; or (x-i) three CDRs of a heavy chain variable region set forth as SEQ ID NO: 739 and three CDRs of a light chain variable region set forth as SEQ ID NO: 740; or (y-i) three CDRs of a heavy chain variable region set forth as SEQ ID NO: 741 and three CDRs of a light chain variable region set forth as SEQ ID NO: 742; or (z-i) three CDRs of a heavy chain variable region set forth as SEQ ID NO: 743 and three CDRs of a light chain variable region set forth as SEQ ID NO: 744; or (a-ii) three CDRs of a heavy chain variable region set forth as SEQ ID NO: 745 and three CDRs of a light chain variable region set forth as SEQ ID NO: 746; or (b-ii) three CDRs of a heavy chain variable region set forth as SEQ ID NO: 747 and three CDRs of a light chain variable region set forth as SEQ ID NO: 748; or (c-ii) three CDRs of a heavy chain variable region set forth as SEQ ID NO: 749 and three CDRs of a light chain variable region set forth as SEQ ID NO: 750; or (d-ii) three CDRs of a heavy chain variable region set forth as SEQ ID NO: 751 and three CDRs of a light chain variable region set forth as SEQ ID NO: 752; or (e-ii) three CDRs of a heavy chain variable region set forth as SEQ ID NO: 753 and three CDRs of a light chain variable region set forth as SEQ ID NO: 754; or (f-ii) three CDRs of a heavy chain variable region set forth as SEQ ID NO: 755 and three CDRs of a light chain variable region set forth as SEQ ID NO: 756; or (g-ii) three CDRs of a heavy chain variable region set forth as SEQ ID NO: 757 and three CDRs of a light chain variable region set forth as SEQ ID NO: 758; or (h-ii) three CDRs of a heavy chain variable region set forth as SEQ ID NO: 759 and three CDRs of a light chain variable region set forth as SEQ ID NO: 760; or (i-ii) three CDRs of a heavy chain variable region set forth as SEQ ID NO:761 and three CDRs of a light chain variable region set forth as SEQ ID NO: 762; or (j-ii) three CDRs of a heavy chain variable region set forth as SEQ ID NO: 763 and three CDRs of a light chain variable region set forth as SEQ ID NO: 764; or (k-ii) three CDRs of a heavy chain variable region set forth as SEQ ID NO: 765 and three CDRs of a light chain variable region set forth as SEQ ID NO: 766; or (l-ii) three CDRs of a heavy chain variable region set forth as SEQ ID NO: 767 and three CDRs of a light chain variable region set forth as SEQ ID NO: 768; or (m-ii) three CDRs of a heavy chain variable region set forth as SEQ ID NO: 769 and three CDRs of a light chain variable region set forth as SEQ ID NO: 770; or (n-ii) three CDRs of a heavy chain variable region set forth as SEQ ID NO: 771 and three CDRs of a light chain variable region set forth as SEQ ID NO: 772; or (o-ii) three CDRs of a heavy chain variable region set forth as SEQ ID NO: 773 and three CDRs of a light chain variable region set forth as SEQ ID NO: 774; or (p-ii) three CDRs of a heavy chain variable region set forth as SEQ ID NO: 775 and three CDRs of a light chain variable region set forth as SEQ ID NO: 776; or (q-ii) three CDRs of a heavy chain variable region set forth as SEQ ID NO: 777 and three CDRs of a light chain variable region set forth as SEQ ID NO: 778; or (r-ii) three CDRs of a heavy chain variable region set forth as SEQ ID NO: 779 and three CDRs of a light chain variable region set forth as SEQ ID NO: 780; or (s-ii) three CDRs of a heavy chain variable region set forth as SEQ ID NO: 781 and three CDRs of a light chain variable region set forth as SEQ ID NO: 782; or (t-ii) three CDRs of a heavy chain variable region set forth as SEQ ID NO: 783 and three CDRs of a light chain variable region set forth as SEQ ID NO: 784; or (u-ii) three CDRs of a heavy chain variable region set forth as SEQ ID NO: 785 and three CDRs of a light chain variable region set forth as SEQ ID NO: 786; or (v-ii) three CDRs of a heavy chain variable region set forth as SEQ ID NO: 787 and three CDRs of a light chain variable region set forth as SEQ ID NO: 788; or (w-ii) three CDRs of a heavy chain variable region set forth as SEQ ID NO: 789 and three CDRs of a light chain variable region set forth as SEQ ID NO: 790; or (x-ii) three CDRs of a heavy chain variable region set forth as SEQ ID NO: 791 and three CDRs of a light chain variable region set forth as SEQ ID NO: 792; or (y-ii) three CDRs of a heavy chain variable region set forth as SEQ ID NO: 793 and three CDRs of a light chain variable region set forth as SEQ ID NO: 794; or (z-ii) three CDRs of a heavy chain variable region set forth as SEQ ID NO: 795 and three CDRs of a light chain variable region set forth as SEQ ID NO: 796; or (a-iii) three CDRs of a heavy chain variable region set forth as SEQ ID NO: 797 and three CDRs of a light chain variable region set forth as SEQ ID NO: 798; or (b-iii) three CDRs of a heavy chain variable region set forth as SEQ ID NO: 799 and three CDRs of a light chain variable region set forth as SEQ ID NO: 800; or (c-iii) three CDRs of a heavy chain variable region set forth as SEQ ID NO: 801 and three CDRs of a light chain variable region set forth as SEQ ID NO: 802; or (d-iii) three CDRs of a heavy chain variable region set forth as SEQ ID NO: 803 and three CDRs of a light chain variable region set forth as SEQ ID NO: 804; or (e-iii) three CDRs of a heavy chain variable region set forth as SEQ ID NO: 805 and three CDRs of a light chain variable region set forth as SEQ ID NO: 806; or (f-iii) three CDRs of a heavy chain variable region set forth as SEQ ID NO: 807 and three CDRs of a light chain variable region set forth as SEQ ID NO: 808; or (g-iii) three CDRs of a heavy chain variable region set forth as SEQ ID NO: 809 and three CDRs of a light chain variable region set forth as SEQ ID NO: 810; or (h-iii) three CDRs of a heavy chain variable region set forth as SEQ ID NO: 811 and three CDRs of a light chain variable region set forth as SEQ ID NO: 812; or (i-iii) three CDRs of a heavy chain variable region set forth as SEQ ID NO: 813 and three CDRs of a light chain variable region set forth as SEQ ID NO: 814; or (j-iii) three CDRs of a heavy chain variable region set forth as SEQ ID NO: 815 and three CDRs of a light chain variable region set forth as SEQ ID NO: 816; or (k-iii) three CDRs of a heavy chain variable region set forth as SEQ ID NO: 817 and three CDRs of a light chain variable region set forth as SEQ ID NO: 818; or (l-iii) three CDRs of a heavy chain variable region set forth as SEQ ID NO: 819 and three CDRs of a light chain variable region set forth as SEQ ID NO: 820; or (m-iii) three CDRs of a heavy chain variable region set forth as SEQ ID NO: 821 and three CDRs of a light chain variable region set forth as SEQ ID NO: 822; or (n-iii) three CDRs of a heavy chain variable region set forth as SEQ ID NO: 823 and three CDRs of a light chain variable region set forth as SEQ ID NO: 824; or (o-iii) three CDRs of a heavy chain variable region set forth as SEQ ID NO: 825 and three CDRs of a light chain variable region set forth as SEQ ID NO: 826; or (p-iii) three CDRs of a heavy chain variable region set forth as SEQ ID NO: 827 and three CDRs of a light chain variable region set forth as SEQ ID NO: 828; or (q-iii) three CDRs of a heavy chain variable region set forth as SEQ ID NO: 829 and three CDRs of a light chain variable region set forth as SEQ ID NO: 830; or (r-iii) three CDRs of a heavy chain variable region set forth as SEQ ID NO: 831 and three CDRs of a light chain variable region set forth as SEQ ID NO: 832; or (s-iii) three CDRs of a heavy chain variable region set forth as SEQ ID NO: 833 and three CDRs of a light chain variable region set forth as SEQ ID NO: 834; or (t-iii) three CDRs of a heavy chain variable region set forth as SEQ ID NO: 835 and three CDRs of a light chain variable region set forth as SEQ ID NO: 836; or (u-iii) three CDRs of a heavy chain variable region set forth as SEQ ID NO: 837 and three CDRs of a light chain variable region set forth as SEQ ID NO: 838; or (v-iii) three CDRs of a heavy chain variable region set forth as SEQ ID NO: 839 and three CDRs of a light chain variable region set forth as SEQ ID NO: 840; or (w-iii) three CDRs of a heavy chain variable region set forth as SEQ ID NO: 841 and three CDRs of a light chain variable region set forth as SEQ ID NO: 842; or (x-iii) three CDRs of a heavy chain variable region set forth as SEQ ID NO: 843 and three CDRs of a light chain variable region set forth as SEQ ID NO: 844; or (y-iii) three CDRs of a heavy chain variable region set forth as SEQ ID NO: 845 and three CDRs of a light chain variable region set forth as SEQ ID NO: 846; or (z-iii) three CDRs of a heavy chain variable region set forth as SEQ ID NO: 847 and three CDRs of a light chain variable region set forth as SEQ ID NO: 848; or (a-iv) three CDRs of a heavy chain variable region set forth as SEQ ID NO: 849 and three CDRs of a light chain variable region set forth as SEQ ID NO: 850; or (b-iv) three CDRs of a heavy chain variable region set forth as SEQ ID NO: 851 and three CDRs of a light chain variable region set forth as SEQ ID NO: 852; or (c-iv) three CDRs of a heavy chain variable region set forth as SEQ ID NO: 853 and three CDRs of a light chain variable region set forth as SEQ ID NO: 854; or (d-iv) three CDRs of a heavy chain variable region set forth as SEQ ID NO: 855 and three CDRs of a light chain variable region set forth as SEQ ID NO: 856; or (e-iv) three CDRs of a heavy chain variable region set forth as SEQ ID NO: 857 and three CDRs of a light chain variable region set forth as SEQ ID NO: 858; or (f-iv) three CDRs of a heavy chain variable region set forth as SEQ ID NO: 859 and three CDRs of a light chain variable region set forth as SEQ ID NO: 860; or (g-iv) three CDRs of a heavy chain variable region set forth as SEQ ID NO: 861 and three CDRs of a light chain variable region set forth as SEQ ID NO: 862; or (h-iv) three CDRs of a heavy chain variable region set forth as SEQ ID NO: 863 and three CDRs of a light chain variable region set forth as SEQ ID NO: 864; or (i-iv) three CDRs of a heavy chain variable region set forth as SEQ ID NO: 865 and three CDRs of a light chain variable region set forth as SEQ ID NO: 866; or (j-iv) three CDRs of a heavy chain variable region set forth as SEQ ID NO: 867 and three CDRs of a light chain variable region set forth as SEQ ID NO: 868; or (k-iv) three CDRs of a heavy chain variable region set forth as SEQ ID NO: 869 and three CDRs of a light chain variable region set forth as SEQ ID NO: 870; or (l-iv) three CDRs of a heavy chain variable region set forth as SEQ ID NO: 871 and three CDRs of a light chain variable region set forth as SEQ ID NO: 872; or (m-iv) three CDRs of a heavy chain variable region set forth as SEQ ID NO: 873 and three CDRs of a light chain variable region set forth as SEQ ID NO: 874; or (n-iv) three CDRs of a heavy chain variable region set forth as SEQ ID NO: 875 and three CDRs of a light chain variable region set forth as SEQ ID NO: 876; or (o-iv) three CDRs of a heavy chain variable region set forth as SEQ ID NO: 877 and three CDRs of a light chain variable region set forth as SEQ ID NO: 878; or (p-iv) three CDRs of a heavy chain variable region set forth as SEQ ID NO: 879 and three CDRs of a light chain variable region set forth as SEQ ID NO: 880; or (q-iv) three CDRs of a heavy chain variable region set forth as SEQ ID NO: 881 and three CDRs of a light chain variable region set forth as SEQ ID NO: 882; or (r-iv) three CDRs of a heavy chain variable region set forth as SEQ ID NO: 883 and three CDRs of a light chain variable region set forth as SEQ ID NO: 884; or (s-iv) three CDRs of a heavy chain variable region set forth as SEQ ID NO: 885 and three CDRs of a light chain variable region set forth as SEQ ID NO: 886; or (t-iv) three CDRs of a heavy chain variable region set forth as SEQ ID NO: 887 and three CDRs of a light chain variable region set forth as SEQ ID NO: 888; or (u-iv) three CDRs of a heavy chain variable region set forth as SEQ ID NO: 889 and three CDRs of a light chain variable region set forth as SEQ ID NO: 890; or (v-iv) three CDRs of a heavy chain variable region set forth as SEQ ID NO: 891 and three CDRs of a light chain variable region set forth as SEQ ID NO: 892; or (w-iv) three CDRs of a heavy chain variable region set forth as SEQ ID NO: 893 and three CDRs of a light chain variable region set forth as SEQ ID NO: 894; or (x-iv) three CDRs of a heavy chain variable region set forth as SEQ ID NO: 895 and three CDRs of a light chain variable region set forth as SEQ ID NO: 896; or (y-iv) three CDRs of a heavy chain variable region set forth as SEQ ID NO: 897 and three CDRs of a light chain variable region set forth as SEQ ID NO: 898; or (z-iv) three CDRs of a heavy chain variable region set forth as SEQ ID NO: 899 and three CDRs of a light chain variable region set forth as SEQ ID NO: 900; or (a-v) three CDRs of a heavy chain variable region set forth as SEQ ID NO: 901 and three CDRs of a light chain variable region set forth as SEQ ID NO: 902; or (b-v) three CDRs of a heavy chain variable region set forth as SEQ ID NO: 903 and three CDRs of a light chain variable region set forth as SEQ ID NO: 904; or (c-v) three CDRs of a heavy chain variable region set forth as SEQ ID NO: 905 and three CDRs of a light chain variable region set forth as SEQ ID NO: 906; or (d-v) three CDRs of a heavy chain variable region set forth as SEQ ID NO: 907 and three CDRs of a light chain variable region set forth as SEQ ID NO: 908; or (e-v) three CDRs of a heavy chain variable region set forth as SEQ ID NO: 909 and three CDRs of a light chain variable region set forth as SEQ ID NO: 910; or (f-v) three CDRs of a heavy chain variable region set forth as SEQ ID NO: 911 and three CDRs of a light chain variable region set forth as SEQ ID NO: 912; or (g-v) three CDRs of a heavy chain variable region set forth as SEQ ID NO: 913 and three CDRs of a light chain variable region set forth as SEQ ID NO: 914; or (h-v) three CDRs of a heavy chain variable region set forth as SEQ ID NO: 915 and three CDRs of a light chain variable region set forth as SEQ ID NO: 916; or (i-v) three CDRs of a heavy chain variable region set forth as SEQ ID NO: 917 and three CDRs of a light chain variable region set forth as SEQ ID NO: 918; or (j-v) three CDRs of a heavy chain variable region set forth as SEQ ID NO: 919 and three CDRs of a light chain variable region set forth as SEQ ID NO: 920; or (k-v) three CDRs of a heavy chain variable region set forth as SEQ ID NO: 921 and three CDRs of a light chain variable region set forth as SEQ ID NO: 922; or (l-v) three CDRs of a heavy chain variable region set forth as SEQ ID NO: 923 and three CDRs of a light chain variable region set forth as SEQ ID NO: 924; or (m-v) three CDRs of a heavy chain variable region set forth as SEQ ID NO: 925 and three CDRs of a light chain variable region set forth as SEQ ID NO: 926; or (n-v) three CDRs of a heavy chain variable region set forth as SEQ ID NO: 927 and three CDRs of a light chain variable region set forth as SEQ ID NO: 928; or (o-v) three CDRs of a heavy chain variable region set forth as SEQ ID NO: 929 and three CDRs of a light chain variable region set forth as SEQ ID NO: 930; or (p-v) three CDRs of a heavy chain variable region set forth as SEQ ID NO: 931 and three CDRs of a light chain variable region set forth as SEQ ID NO: 932; or (q-v) three CDRs of a heavy chain variable region set forth as SEQ ID NO: 933 and three CDRs of a light chain variable region set forth as SEQ ID NO: 934; or (r-v) three CDRs of a heavy chain variable region set forth as SEQ ID NO: 935 and three CDRs of a light chain variable region set forth as SEQ ID NO: 936; or (s-v) three CDRs of a heavy chain variable region set forth as SEQ ID NO: 937 and three CDRs of a light chain variable region set forth as SEQ ID NO: 938; or (t-v) three CDRs of a heavy chain variable region set forth as SEQ ID NO: 939 and three CDRs of a light chain variable region set forth as SEQ ID NO: 940; or (u-v) three CDRs of a heavy chain variable region set forth as SEQ ID NO: 941 and three CDRs of a light chain variable region set forth as SEQ ID NO: 942; or (v-v) three CDRs of a heavy chain variable region set forth as SEQ ID NO: 943 and three CDRs of a light chain variable region set forth as SEQ ID NO: 944; or (w-v) three CDRs of a heavy chain variable region set forth as SEQ ID NO: 945 and three CDRs of a light chain variable region set forth as SEQ ID NO: 946; or (x-v) three CDRs of a heavy chain variable region set forth as SEQ ID NO: 947 and three CDRs of a light chain variable region set forth as SEQ ID NO: 948; or (y-v) three CDRs of a heavy chain variable region set forth as SEQ ID NO: 949 and three CDRs of a light chain variable region set forth as SEQ ID NO: 950; or (z-v) three CDRs of a heavy chain variable region set forth as SEQ ID NO: 951 and three CDRs of a light chain variable region set forth as SEQ ID NO: 952; or (a-vi) three CDRs of a heavy chain variable region set forth as SEQ ID NO: 953 and three CDRs of a light chain variable region set forth as SEQ ID NO: 954; or (b-vi) three CDRs of a heavy chain variable region set forth as SEQ ID NO: 955 and three CDRs of a light chain variable region set forth as SEQ ID NO: 956; or (c-vi) three CDRs of a heavy chain variable region set forth as SEQ ID NO: 957 and three CDRs of a light chain variable region set forth as SEQ ID NO: 958; or (d-vi) three CDRs of a heavy chain variable region set forth as SEQ ID NO: 959 and three CDRs of a light chain variable region set forth as SEQ ID NO: 960; or (e-vi) three CDRs of a heavy chain variable region set forth as SEQ ID NO: 961 and three CDRs of a light chain variable region set forth as SEQ ID NO: 962; or (f-vi) three CDRs of a heavy chain variable region set forth as SEQ ID NO: 963 and three CDRs of a light chain variable region set forth as SEQ ID NO: 964; or (g-vi) three CDRs of a heavy chain variable region set forth as SEQ ID NO: 965 and three CDRs of a light chain variable region set forth as SEQ ID NO: 966; or (h-vi) three CDRs of a heavy chain variable region set forth as SEQ ID NO: 967 and three CDRs of a light chain variable region set forth as SEQ ID NO: 968; or (i-vi) three CDRs of a heavy chain variable region set forth as SEQ ID NO: 969 and three CDRs of a light chain variable region set forth as SEQ ID NO: 970; or (j-vi) three CDRs of a heavy chain variable region set forth as SEQ ID NO: 971 and three CDRs of a light chain variable region set forth as SEQ ID NO: 972; or (k-vi) three CDRs of a heavy chain variable region set forth as SEQ ID NO: 973 and three CDRs of a light chain variable region set forth as SEQ ID NO: 974; or (l-vi) three CDRs of a heavy chain variable region set forth as SEQ ID NO: 975 and three CDRs of a light chain variable region set forth as SEQ ID NO: 976; or (m-vi) three CDRs of a heavy chain variable region set forth as SEQ ID NO: 977 and three CDRs of a light chain variable region set forth as SEQ ID NO: 978; or (n-vi) three CDRs of a heavy chain variable region set forth as SEQ ID NO: 979 and three CDRs of a light chain variable region set forth as SEQ ID NO: 980; or (o-vi) three CDRs of a heavy chain variable region set forth as SEQ ID NO: 981 and three CDRs of a light chain variable region set forth as SEQ ID NO: 982; or (p-vi) three CDRs of a heavy chain variable region set forth as SEQ ID NO: 983 and three CDRs of a light chain variable region set forth as SEQ ID NO: 984; or (q-vi) three CDRs of a heavy chain variable region set forth as SEQ ID NO: 985 and three CDRs of a light chain variable region set forth as SEQ ID NO: 986; or (r-vi) three CDRs of a heavy chain variable region set forth as SEQ ID NO: 987 and three CDRs of a light chain variable region set forth as SEQ ID NO: 988; or (s-vi) three CDRs of a heavy chain variable region set forth as SEQ ID NO: 989 and three CDRs of a light chain variable region set forth as SEQ ID NO: 990; or (t-vi) three CDRs of a heavy chain variable region set forth as SEQ ID NO: 991 and three CDRs of a light chain variable region set forth as SEQ ID NO: 992; or (u-vi) three CDRs of a heavy chain variable region set forth as SEQ ID NO: 993 and three CDRs of a light chain variable region set forth as SEQ ID NO: 994; or (v-vi) three CDRs of a heavy chain variable region set forth as SEQ ID NO: 995 and three CDRs of a light chain variable region set forth as SEQ ID NO: 996; or (w-vi) three CDRs of a heavy chain variable region set forth as SEQ ID NO: 997 and three CDRs of a light chain variable region set forth as SEQ ID NO: 998; or (x-vi) three CDRs of a heavy chain variable region set forth as SEQ ID NO: 999 and three CDRs of a light chain variable region set forth as SEQ ID NO: 1000; or (y-vi) three CDRs of a heavy chain variable region set forth as SEQ ID NO: 1001 and three CDRs of a light chain variable region set forth as SEQ ID NO: 1002; or (z-vi) three CDRs of a heavy chain variable region set forth as SEQ ID NO: 1003 and three CDRs of a light chain variable region set forth as SEQ ID NO: 1004; or (a-vii) three CDRs of a heavy chain variable region set forth as SEQ ID NO: 1005 and three CDRs of a light chain variable region set forth as SEQ ID NO: 1006; or (b-vii) three CDRs of a heavy chain variable region set forth as SEQ ID NO: 1007 and three CDRs of a light chain variable region set forth as SEQ ID NO: 1008; or (c-vii) three CDRs of a heavy chain variable region set forth as SEQ ID NO: 1009 and three CDRs of a light chain variable region set forth as SEQ ID NO: 1010; or (d-vii) three CDRs of a heavy chain variable region set forth as SEQ ID NO: 1011 and three CDRs of a light chain variable region set forth as SEQ ID NO: 1012; or (e-vii) three CDRs of a heavy chain variable region set forth as SEQ ID NO: 1013 and three CDRs of a light chain variable region set forth as SEQ ID NO: 1014; or (f-vii) three CDRs of a heavy chain variable region set forth as SEQ ID NO: 1015 and three CDRs of a light chain variable region set forth as SEQ ID NO: 1016; or (g-vii) three CDRs of a heavy chain variable region set forth as SEQ ID NO: 1017 and three CDRs of a light chain variable region set forth as SEQ ID NO: 1018; or (h-vii) three CDRs of a heavy chain variable region set forth as SEQ ID NO: 1019 and three CDRs of a light chain variable region set forth as SEQ ID NO: 1020; or (i-vii) three CDRs of a heavy chain variable region set forth as SEQ ID NO: 1021 and three CDRs of a light chain variable region set forth as SEQ ID NO: 1022; or (j-vii) three CDRs of a heavy chain variable region set forth as SEQ ID NO: 1023 and three CDRs of a light chain variable region set forth as SEQ ID NO: 1024; or (k-vii) three CDRs of a heavy chain variable region set forth as SEQ ID NO: 1025 and three CDRs of a light chain variable region set forth as SEQ ID NO: 1026; or (l-vii) three CDRs of a heavy chain variable region set forth as SEQ ID NO: 1027 and three CDRs of a light chain variable region set forth as SEQ ID NO: 1028; or (m-vii) three CDRs of a heavy chain variable region set forth as SEQ ID NO: 1029 and three CDRs of a light chain variable region set forth as SEQ ID NO: 1030; or (n-vii) three CDRs of a heavy chain variable region set forth as SEQ ID NO: 1031 and three CDRs of a light chain variable region set forth as SEQ ID NO: 1032; or (o-vii) three CDRs of a heavy chain variable region set forth as SEQ ID NO: 1033 and three CDRs of a light chain variable region set forth as SEQ ID NO: 1034; or (p-vii) three CDRs of a heavy chain variable region set forth as SEQ ID NO: 1035 and three CDRs of a light chain variable region set forth as SEQ ID NO: 1036; or (q-vii) three CDRs of a heavy chain variable region set forth as SEQ ID NO: 1037 and three CDRs of a light chain variable region set forth as SEQ ID NO: 1038; or (r-vii) three CDRs of a heavy chain variable region set forth as SEQ ID NO: 1039 and three CDRs of a light chain variable region set forth as SEQ ID NO: 1040; or (s-vii) three CDRs of a heavy chain variable region set forth as SEQ ID NO: 1041 and three CDRs of a light chain variable region set forth as SEQ ID NO: 1042; or (t-vii) three CDRs of a heavy chain variable region set forth as SEQ ID NO: 1043 and three CDRs of a light chain variable region set forth as SEQ ID NO: 1044; or (u-vii) three CDRs of a heavy chain variable region set forth as SEQ ID NO: 1045 and three CDRs of a light chain variable region set forth as SEQ ID NO: 1046; or (v-vii) three CDRs of a heavy chain variable region set forth as SEQ ID NO: 1047 and three CDRs of a light chain variable region set forth as SEQ ID NO: 1048; or (w-vii) three CDRs of a heavy chain variable region set forth as SEQ ID NO: 1049 and three CDRs of a light chain variable region set forth as SEQ ID NO: 1050; or (x-vii) three CDRs of a heavy chain variable region set forth as SEQ ID NO: 1051 and three CDRs of a light chain variable region set forth as SEQ ID NO: 1052; or (y-vii) three CDRs of a heavy chain variable region set forth as SEQ ID NO: 1053 and three CDRs of a light chain variable region set forth as SEQ ID NO: 1054; or (z-vii) three CDRs of a heavy chain variable region set forth as SEQ ID NO: 1055 and three CDRs of a light chain variable region set forth as SEQ ID NO: 1056; or (a-viii) three CDRs of a heavy chain variable region set forth as SEQ ID NO: 1057 and three CDRs of a light chain variable region set forth as SEQ ID NO: 1058; or (b-viii) three CDRs of a heavy chain variable region set forth as SEQ ID NO: 1059 and three CDRs of a light chain variable region set forth as SEQ ID NO: 1060; or (c-viii) three CDRs of a heavy chain variable region set forth as SEQ ID NO: 1061 and three CDRs of a light chain variable region set forth as SEQ ID NO: 1062; or (d-viii) three CDRs of a heavy chain variable region set forth as SEQ ID NO: 1063 and three CDRs of a light chain variable region set forth as SEQ ID NO: 1064; or (e-viii) three CDRs of a heavy chain variable region set forth as SEQ ID NO: 1065 and three CDRs of a light chain variable region set forth as SEQ ID NO: 1066; or (f-viii) three CDRs of a heavy chain variable region set forth as SEQ ID NO: 1067 and three CDRs of a light chain variable region set forth as SEQ ID NO: 1068; or (g-viii) three CDRs of a heavy chain variable region set forth as SEQ ID NO: 1069 and three CDRs of a light chain variable region set forth as SEQ ID NO: 1070; or (h-viii) three CDRs of a heavy chain variable region set forth as SEQ ID NO: 1071 and three CDRs of a light chain variable region set forth as SEQ ID NO: 1072; or (i-viii) three CDRs of a heavy chain variable region set forth as SEQ ID NO: 1073 and three CDRs of a light chain variable region set forth as SEQ ID NO: 1074; or (j-viii) three CDRs of a heavy chain variable region set forth as SEQ ID NO: 1075 and three CDRs of a light chain variable region set forth as SEQ ID NO: 1076; or (k-viii) three CDRs of a heavy chain variable region set forth as SEQ ID NO: 1077 and three CDRs of a light chain variable region set forth as SEQ ID NO: 1078; or (l-viii) three CDRs of a heavy chain variable region set forth as SEQ ID NO: 1079 and three CDRs of a light chain variable region set forth as SEQ ID NO: 1080; or (m-viii) three CDRs of a heavy chain variable region set forth as SEQ ID NO: 1081 and three CDRs of a light chain variable region set forth as SEQ ID NO: 1082; or (n-viii) three CDRs of a heavy chain variable region set forth as SEQ ID NO: 1083 and three CDRs of a light chain variable region set forth as SEQ ID NO: 1084; or (o-viii) three CDRs of a heavy chain variable region set forth as SEQ ID NO: 1085 and three CDRs of a light chain variable region set forth as SEQ ID NO: 1086; or (p-viii) three CDRs of a heavy chain variable region set forth as SEQ ID NO: 1087 and three CDRs of a light chain variable region set forth as SEQ ID NO: 1088; or (q-viii) three CDRs of a heavy chain variable region set forth as SEQ ID NO: 1089 and three CDRs of a light chain variable region set forth as SEQ ID NO: 1090; or (r-viii) three CDRs of a heavy chain variable region set forth as SEQ ID NO: 1091 and three CDRs of a light chain variable region set forth as SEQ ID NO: 1092; or (s-viii) three CDRs of a heavy chain variable region set forth as SEQ ID NO: 1093 and three CDRs of a light chain variable region set forth as SEQ ID NO: 1094; or (t-viii) three CDRs of a heavy chain variable region set forth as SEQ ID NO: 1095 and three CDRs of a light chain variable region set forth as SEQ ID NO: 1096; or (u-viii) three CDRs of a heavy chain variable region set forth as SEQ ID NO: 1097 and three CDRs of a light chain variable region set forth as SEQ ID NO: 1098; or (v-viii) three CDRs of a heavy chain variable region set forth as SEQ ID NO: 1099 and three CDRs of a light chain variable region set forth as SEQ ID NO: 1100; or (w-viii) three CDRs of a heavy chain variable region set forth as SEQ ID NO: 1101 and three CDRs of a light chain variable region set forth as SEQ ID NO: 1102; or (x-viii) three CDRs of a heavy chain variable region set forth as SEQ ID NO: 1103 and three CDRs of a light chain variable region set forth as SEQ ID NO: 1104; or (y-vii) three CDRs of a heavy chain variable region set forth as SEQ ID NO: 1105 and three CDRs of a light chain variable region set forth as SEQ ID NO: 1106; or (z-viii) three CDRs of a heavy chain variable region set forth as SEQ ID NO: 1107 and three CDRs of a light chain variable region set forth as SEQ ID NO: 1108; or (a-vix) three CDRs of a heavy chain variable region set forth as SEQ ID NO: 1109 and three CDRs of a light chain variable region set forth as SEQ ID NO: 1110; or (b-vix) three CDRs of a heavy chain variable region set forth as SEQ ID NO: 1111 and three CDRs of a light chain variable region set forth as SEQ ID NO: 1112; or (c-vix) three CDRs of a heavy chain variable region set forth as SEQ ID NO: 1113 and three CDRs of a light chain variable region set forth as SEQ ID NO: 1114; or (d-vix) three CDRs of a heavy chain variable region set forth as SEQ ID NO: 1115 and three CDRs of a light chain variable region set forth as SEQ ID NO: 1116; or (e-vix) three CDRs of a heavy chain variable region set forth as SEQ ID NO: 1117 and three CDRs of a light chain variable region set forth as SEQ ID NO: 1118; or (f-vix) three CDRs of a heavy chain variable region set forth as SEQ ID NO: 1119 and three CDRs of a light chain variable region set forth as SEQ ID NO: 1120; or (g-vix) three CDRs of a heavy chain variable region set forth as SEQ ID NO: 1121 and three CDRs of a light chain variable region set forth as SEQ ID NO: 1122; or (h-vix) three CDRs of a heavy chain variable region set forth as SEQ ID NO: 1123 and three CDRs of a light chain variable region set forth as SEQ ID NO: 1124; or (i-vix) three CDRs of a heavy chain variable region set forth as SEQ ID NO: 1125 and three CDRs of a light chain variable region set forth as SEQ ID NO: 1126; or (j-vix) three CDRs of a heavy chain variable region set forth as SEQ ID NO: 1127 and three CDRs of a light chain variable region set forth as SEQ ID NO: 1128; or (k-vix) three CDRs of a heavy chain variable region set forth as SEQ ID NO: 1129 and three CDRs of a light chain variable region set forth as SEQ ID NO: 1130; or (l-vix) three CDRs of a heavy chain variable region set forth as SEQ ID NO: 1131 and three CDRs of a light chain variable region set forth as SEQ ID NO: 1132; or (m-vix) three CDRs of a heavy chain variable region set forth as SEQ ID NO: 1133 and three CDRs of a light chain variable region set forth as SEQ ID NO: 1134; or (n-vix) three CDRs of a heavy chain variable region set forth as SEQ ID NO: 1135 and three CDRs of a light chain variable region set forth as SEQ ID NO: 1136; or (o-vix) three CDRs of a heavy chain variable region set forth as SEQ ID NO: 1137 and three CDRs of a light chain variable region set forth as SEQ ID NO: 1138; or (p-vix) three CDRs of a heavy chain variable region set forth as SEQ ID NO: 1139 and three CDRs of a light chain variable region set forth as SEQ ID NO: 1140; or (q-vix) three CDRs of a heavy chain variable region set forth as SEQ ID NO: 1141 and three CDRs of a light chain variable region set forth as SEQ ID NO: 1142; or (r-vix) three CDRs of a heavy chain variable region set forth as SEQ ID NO: 1143 and three CDRs of a light chain variable region set forth as SEQ ID NO: 1144; or (s-vix) three CDRs of a heavy chain variable region set forth as SEQ ID NO: 1145 and three CDRs of a light chain variable region set forth as SEQ ID NO: 1146; or (t-vix) three CDRs of a heavy chain variable region set forth as SEQ ID NO: 1147 and three CDRs of a light chain variable region set forth as SEQ ID NO: 1148; or (u-vix) three CDRs of a heavy chain variable region set forth as SEQ ID NO: 1149 and three CDRs of a light chain variable region set forth as SEQ ID NO: 1150; or (v-vix) three CDRs of a heavy chain variable region set forth as SEQ ID NO: 1151 and three CDRs of a light chain variable region set forth as SEQ ID NO: 1152; or (w-vix) three CDRs of a heavy chain variable region set forth as SEQ ID NO: 1153 and three CDRs of a light chain variable region set forth as SEQ ID NO: 1154; or (x-ix) three CDRs of a heavy chain variable region set forth as SEQ ID NO: 1155 and three CDRs of a light chain variable region set forth as SEQ ID NO: 1156; or (y-ix) three CDRs of a heavy chain variable region set forth as SEQ ID NO: 1157 and three CDRs of a light chain variable region set forth as SEQ ID NO: 1158; or (z-ix) three CDRs of a heavy chain variable region set forth as SEQ ID NO: 1159 and three CDRs of a light chain variable region set forth as SEQ ID NO: 1160; or (a-x) three CDRs of a heavy chain variable region set forth as SEQ ID NO: 1161 and three CDRs of a light chain variable region set forth as SEQ ID NO: 1162; or (b-x) three CDRs of a heavy chain variable region set forth as SEQ ID NO: 1163 and three CDRs of a light chain variable region set forth as SEQ ID NO: 1164; or (c-x) three CDRs of a heavy chain variable region set forth as SEQ ID NO: 1165 and three CDRs of a light chain variable region set forth as SEQ ID NO: 1166; or (d-x) three CDRs of a heavy chain variable region set forth as SEQ ID NO: 1167 and three CDRs of a light chain variable region set forth as SEQ ID NO: 1168; or (e-x) three CDRs of a heavy chain variable region set forth as SEQ ID NO: 1169 and three CDRs of a light chain variable region set forth as SEQ ID NO: 1170; or (f-x) three CDRs of a heavy chain variable region set forth as SEQ ID NO: 1171 and three CDRs of a light chain variable region set forth as SEQ ID NO: 1172; or (g-x) three CDRs of a heavy chain variable region set forth as SEQ ID NO: 1173 and three CDRs of a light chain variable region set forth as SEQ ID NO: 1174; or (h-x) three CDRs of a heavy chain variable region set forth as SEQ ID NO: 1175 and three CDRs of a light chain variable region set forth as SEQ ID NO: 1176; or (i-x) three CDRs of a heavy chain variable region set forth as SEQ ID NO: 1177 and three CDRs of a light chain variable region set forth as SEQ ID NO: 1178; or (j-x) three CDRs of a heavy chain variable region set forth as SEQ ID NO: 1179 and three CDRs of a light chain variable region set forth as SEQ ID NO: 1180; or (k-x) three CDRs of a heavy chain variable region set forth as SEQ ID NO: 1181 and three CDRs of a light chain variable region set forth as SEQ ID NO: 1182; or (l-x) three CDRs of a heavy chain variable region set forth as SEQ ID NO: 1183 and three CDRs of a light chain variable region set forth as SEQ ID NO: 1184; or (m-x) three CDRs of a heavy chain variable region set forth as SEQ ID NO: 1185 and three CDRs of a light chain variable region set forth as SEQ ID NO: 1186; or (n-x) three CDRs of a heavy chain variable region set forth as SEQ ID NO: 1187 and three CDRs of a light chain variable region set forth as SEQ ID NO: 1188; or (o-x) three CDRs of a heavy chain variable region set forth as SEQ ID NO: 1189 and three CDRs of a light chain variable region set forth as SEQ ID NO: 1190; or (p-x) three CDRs of a heavy chain variable region set forth as SEQ ID NO: 1191 and three CDRs of a light chain variable region set forth as SEQ ID NO: 1192; or (q-x) three CDRs of a heavy chain variable region set forth as SEQ ID NO: 1193 and three CDRs of a light chain variable region set forth as SEQ ID NO: 1194; or (r-x) three CDRs of a heavy chain variable region set forth as SEQ ID NO: 1195 and three CDRs of a light chain variable region set forth as SEQ ID NO: 1196; or (s-x) three CDRs of a heavy chain variable region set forth as SEQ ID NO: 1197 and three CDRs of a light chain variable region set forth as SEQ ID NO: 1198; or (t-x) three CDRs of a heavy chain variable region set forth as SEQ ID NO: 1199 and three CDRs of a light chain variable region set forth as SEQ ID NO: 1200; or (u-x) three CDRs of a heavy chain variable region set forth as SEQ ID NO: 1201 and three CDRs of a light chain variable region set forth as SEQ ID NO: 1202; or (v-x) three CDRs of a heavy chain variable region set forth as SEQ ID NO: 1203 and three CDRs of a light chain variable region set forth as SEQ ID NO: 1204; or (w-x) three CDRs of a heavy chain variable region set forth as SEQ ID NO: 1205 and three CDRs of a light chain variable region set forth as SEQ ID NO: 1206; or (x-x) three CDRs of a heavy chain variable region set forth as SEQ ID NO: 1207 and three CDRs of a light chain variable region set forth as SEQ ID NO: 1208; or (y-x) three CDRs of a heavy chain variable region set forth as SEQ ID NO: 1209 and three CDRs of a light chain variable region set forth as SEQ ID NO: 1210; or (z-x) three CDRs of a heavy chain variable region set forth as SEQ ID NO: 1211 and three CDRs of a light chain variable region set forth as SEQ ID NO: 1212; or (a-xi) three CDRs of a heavy chain variable region set forth as SEQ ID NO: 1213 and three CDRs of a light chain variable region set forth as SEQ ID NO: 1214; or (b-xi) three CDRs of a heavy chain variable region set forth as SEQ ID NO: 1215 and three CDRs of a light chain variable region set forth as SEQ ID NO: 1216; or (c-xi) three CDRs of a heavy chain variable region set forth as SEQ ID NO: 1217 and three CDRs of a light chain variable region set forth as SEQ ID NO: 1218; or (d-xi) three CDRs of a heavy chain variable region set forth as SEQ ID NO: 1219 and three CDRs of a light chain variable region set forth as SEQ ID NO: 1220; or (e-xi) three CDRs of a heavy chain variable region set forth as SEQ ID NO: 1221 and three CDRs of a light chain variable region set forth as SEQ ID NO: 1222; or (f-xi) three CDRs of a heavy chain variable region set forth as SEQ ID NO: 1223 and three CDRs of a light chain variable region set forth as SEQ ID NO: 1224; or (g-xi) three CDRs of a heavy chain variable region set forth as SEQ ID NO: 1225 and three CDRs of a light chain variable region set forth as SEQ ID NO: 1226; or (h-xi) three CDRs of a heavy chain variable region set forth as SEQ ID NO: 1227 and three CDRs of a light chain variable region set forth as SEQ ID NO: 1228; or (i-xi) three CDRs of a heavy chain variable region set forth as SEQ ID NO: 1229 and three CDRs of a light chain variable region set forth as SEQ ID NO: 1230; or (j-xi) three CDRs of a heavy chain variable region set forth as SEQ ID NO: 1231 and three CDRs of a light chain variable region set forth as SEQ ID NO: 1232; or (k-xi) three CDRs of a heavy chain variable region set forth as SEQ ID NO: 1233 and three CDRs of a light chain variable region set forth as SEQ ID NO: 1234; or (l-xi) three CDRs of a heavy chain variable region set forth as SEQ ID NO: 1235 and three CDRs of a light chain variable region set forth as SEQ ID NO: 1236; or (m-xi) three CDRs of a heavy chain variable region set forth as SEQ ID NO: 1237 and three CDRs of a light chain variable region set forth as SEQ ID NO: 1238; or (n-xi) three CDRs of a heavy chain variable region set forth as SEQ ID NO: 1239 and three CDRs of a light chain variable region set forth as SEQ ID NO: 1240; or (o-xi) three CDRs of a heavy chain variable region set forth as SEQ ID NO: 1241 and three CDRs of a light chain variable region set forth as SEQ ID NO: 1242; or (p-xi) three CDRs of a heavy chain variable region set forth as SEQ ID NO: 1243 and three CDRs of a light chain variable region set forth as SEQ ID NO: 1244; or (q-xi) three CDRs of a heavy chain variable region set forth as SEQ ID NO: 1245 and three CDRs of a light chain variable region set forth as SEQ ID NO: 1246; or (r-xi) three CDRs of a heavy chain variable region set forth as SEQ ID NO: 1247 and three CDRs of a light chain variable region set forth as SEQ ID NO: 1248; or (s-xi) three CDRs of a heavy chain variable region set forth as SEQ ID NO: 1249 and three CDRs of a light chain variable region set forth as SEQ ID NO: 1250; or (t-xi) three CDRs of a heavy chain variable region set forth as SEQ ID NO: 1251 and three CDRs of a light chain variable region set forth as SEQ ID NO: 1252; or (u-xi) three CDRs of a heavy chain variable region set forth as SEQ ID NO: 1253 and three CDRs of a light chain variable region set forth as SEQ ID NO: 1254; or (v-xi) three CDRs of a heavy chain variable region set forth as SEQ ID NO: 1255 and three CDRs of a light chain variable region set forth as SEQ ID NO: 1256; or (w-xi) three CDRs of a heavy chain variable region set forth as SEQ ID NO: 1257 and three CDRs of a light chain variable region set forth as SEQ ID NO: 1258; or (x-xii) three CDRs of a heavy chain variable region set forth as SEQ ID NO: 1259 and three CDRs of a light chain variable region set forth as SEQ ID NO: 1260; or (y-xii) three CDRs of a heavy chain variable region set forth as SEQ ID NO: 1261 and three CDRs of a light chain variable region set forth as SEQ ID NO: 1262; or (z-xii) three CDRs of a heavy chain variable region set forth as SEQ ID NO: 1263 and three CDRs of a light chain variable region set forth as SEQ ID NO: 1264; or (a-xii) three CDRs of a heavy chain variable region set forth as SEQ ID NO: 1265 and three CDRs of a light chain variable region set forth as SEQ ID NO: 1266; or (b-xii) three CDRs of a heavy chain variable region set forth as SEQ ID NO: 1267 and three CDRs of a light chain variable region set forth as SEQ ID NO: 1268; or (c-xii) three CDRs of a heavy chain variable region set forth as SEQ ID NO: 1269 and three CDRs of a light chain variable region set forth as SEQ ID NO: 1270; or (d-xii) three CDRs of a heavy chain variable region set forth as SEQ ID NO: 1271 and three CDRs of a light chain variable region set forth as SEQ ID NO: 1272; or (e-xii) three CDRs of a heavy chain variable region set forth as SEQ ID NO: 1273 and three CDRs of a light chain variable region set forth as SEQ ID NO: 1274; or (f-xii) three CDRs of a heavy chain variable region set forth as SEQ ID NO: 1275 and three CDRs of a light chain variable region set forth as SEQ ID NO: 1276; or (g-xii) three CDRs of a heavy chain variable region set forth as SEQ ID NO: 1277 and three CDRs of a light chain variable region set forth as SEQ ID NO: 1278; or (h-xii) three CDRs of a heavy chain variable region set forth as SEQ ID NO: 1279 and three CDRs of a light chain variable region set forth as SEQ ID NO: 1280; or (i-xii) three CDRs of a heavy chain variable region set forth as SEQ ID NO: 1281 and three CDRs of a light chain variable region set forth as SEQ ID NO: 1282; or (j-xii) three CDRs of a heavy chain variable region set forth as SEQ ID NO: 1283 and three CDRs of a light chain variable region set forth as SEQ ID NO: 1284; or (k-xii) three CDRs of a heavy chain variable region set forth as SEQ ID NO: 1285 and three CDRs of a light chain variable region set forth as SEQ ID NO: 1286; or (l-xii) three CDRs of a heavy chain variable region set forth as SEQ ID NO: 1287 and three CDRs of a light chain variable region set forth as SEQ ID NO: 1288; or (m-xii) three CDRs of a heavy chain variable region set forth as SEQ ID NO: 1289 and three CDRs of a light chain variable region set forth as SEQ ID NO: 1290; or (n-xii) three CDRs of a heavy chain variable region set forth as SEQ ID NO: 1291 and three CDRs of a light chain variable region set forth as SEQ ID NO: 1292; or (o-xii) three CDRs of a heavy chain variable region set forth as SEQ ID NO: 1293 and three CDRs of a light chain variable region set forth as SEQ ID NO: 1294; or (p-xii) three CDRs of a heavy chain variable region set forth as SEQ ID NO: 1295 and three CDRs of a light chain variable region set forth as SEQ ID NO: 1296; or (q-xii) three CDRs of a heavy chain variable region set forth as SEQ ID NO: 1297 and three CDRs of a light chain variable region set forth as SEQ ID NO: 1298; or (r-xii) three CDRs of a heavy chain variable region set forth as SEQ ID NO: 1299 and three CDRs of a light chain variable region set forth as SEQ ID NO: 1300; or (s-xii) three CDRs of a heavy chain variable region set forth as SEQ ID NO: 1301 and three CDRs of a light chain variable region set forth as SEQ ID NO: 1302: or (t-xii) three CDRs of a heavy chain variable region set forth as SEQ ID NO: 1303 and three CDRs of a light chain variable region set forth as SEQ ID NO: 1304: or (u-xii) three CDRs of a heavy chain variable region set forth as SEQ ID NO: 1305 and three CDRs of a light chain variable region set forth as SEQ ID NO: 1306: or (v-xii) three CDRs of a heavy chain variable region set forth as SEQ ID NO: 1307 and three CDRs of a light chain variable region set forth as SEQ ID NO: 1308: or (w-xii) three CDRs of a heavy chain variable region set forth as SEQ ID NO: 1309 and three CDRs of a light chain variable region set forth as SEQ ID NO: 1310: or (x-xii) three CDRs of a heavy chain variable region set forth as SEQ ID NO: 1311 and three CDRs of a light chain variable region set forth as SEQ ID NO: 1312: or (y-xii) three CDRs of a heavy chain variable region set forth as SEQ ID NO: 1313 and three CDRs of a light chain variable region set forth as SEQ ID NO: 1314: or (z-xii) three CDRs of a heavy chain variable region set forth as SEQ ID NO: 1315 and three CDRs of a light chain variable region set forth as SEQ ID NO: 1316: or (a-xiii) three CDRs of a heavy chain variable region set forth as SEQ ID NO: 1317 and three CDRs of a light chain variable region set forth as SEQ ID NO: 1318: or (b-xiii) three CDRs of a heavy chain variable region set forth as SEQ ID NO: 1319 and three CDRs of a light chain variable region set forth as SEQ ID NO: 1320: or (c-xiii) three CDRs of a heavy chain variable region set forth as SEQ ID NO: 2751 and three CDRs of a light chain variable region set forth as SEQ ID NO: 2752; or (d-xiii) three CDRs of a heavy chain variable region set forth as SEQ ID NO: 2753 and three CDRs of a light chain variable region set forth as SEQ ID NO: 2754; or (e-xiii) three CDRs of a heavy chain variable region set forth as SEQ ID NO: 2755 and three CDRs of a light chain variable region set forth as SEQ ID NO: 2756; or (f-xiii) three CDRs of a heavy chain variable region set forth as SEQ ID NO: 2757 and three CDRs of a light chain variable region set forth as SEQ ID NO: 2758; or (g-xiii) three CDRs of a heavy chain variable region set forth as SEQ ID NO: 2759 and three CDRs of a light chain variable region set forth as SEQ ID NO: 2760; or (h-xiii) three CDRs of a heavy chain variable region set forth as SEQ ID NO: 2761 and three CDRs of a light chain variable region set forth as SEQ ID NO: 2762; or (i-xiii) three CDRs of a heavy chain variable region set forth as SEQ ID NO: 2763 and three CDRs of a light chain variable region set forth as SEQ ID NO: 2764; or (j-xiii) three CDRs of a heavy chain variable region set forth as SEQ ID NO: 2765 and three CDRs of a light chain variable region set forth as SEQ ID NO: 2766; or (k-xiii) three CDRs of a heavy chain variable region set forth as SEQ ID NO: 2767 and three CDRs of a light chain variable region set forth as SEQ ID NO: 2768; or (l-xiii) three CDRs of a heavy chain variable region set forth as SEQ ID NO: 2769 and three CDRs of a light chain variable region set forth as SEQ ID NO: 2770; or (m-xiii) three CDRs of a heavy chain variable region set forth as SEQ ID NO: 2771 and three CDRs of a light chain variable region set forth as SEQ ID NO: 2772; or (n-xiii) three CDRs of a heavy chain variable region set forth as SEQ ID NO: 2773 and three CDRs of a light chain variable region set forth as SEQ ID NO: 2774; or (o-xiii) three CDRs of a heavy chain variable region set forth as SEQ ID NO: 2775 and three CDRs of a light chain variable region set forth as SEQ ID NO: 2776; or (p-xiii) three CDRs of a heavy chain variable region set forth as SEQ ID NO: 2777 and three CDRs of a light chain variable region set forth as SEQ ID NO: 2778; or (q-xiii) three CDRs of a heavy chain variable region set forth as SEQ ID NO: 2779 and three CDRs of a light chain variable region set forth as SEQ ID NO: 2780; or (r-xiii) three CDRs of a heavy chain variable region set forth as SEQ ID NO: 2781 and three CDRs of a light chain variable region set forth as SEQ ID NO: 2782; or (s-xiii) three CDRs of a heavy chain variable region set forth as SEQ ID NO: 2783 and three CDRs of a light chain variable region set forth as SEQ ID NO: 2784; or (t-xiii) three CDRs of a heavy chain variable region set forth as SEQ ID NO: 2785 and three CDRs of a light chain variable region set forth as SEQ ID NO: 2786; or (u-xiii) three CDRs of a heavy chain variable region set forth as SEQ ID NO: 2787 and three CDRs of a light chain variable region set forth as SEQ ID NO: 2788; or (v-xiii) three CDRs of a heavy chain variable region set forth as SEQ ID NO: 2789 and three CDRs of a light chain variable region set forth as SEQ ID NO: 2790; or (w-xiii) three CDRs of a heavy chain variable region set forth as SEQ ID NO: 2791 and three CDRs of a light chain variable region set forth as SEQ ID NO: 2792; or (x-xiii) three CDRs of a heavy chain variable region set forth as SEQ ID NO: 2793 and three CDRs of a light chain variable region set forth as SEQ ID NO: 2794: or (y-xiii) three CDRs of a heavy chain variable region set forth as SEQ ID NO: 2795 and three CDRs of a light chain variable region set forth as SEQ ID NO: 2796: or (z-xiii) three CDRs of a heavy chain variable region set forth as SEQ ID NO: 2797 and three CDRs of a light chain variable region set forth as SEQ ID NO: 2798: or (a-xiv) three CDRs of a heavy chain variable region set forth as SEQ ID NO: 2799 and three CDRs of a light chain variable region set forth as SEQ ID NO: 2800: or (b-xiv) three CDRs of a heavy chain variable region set forth as SEQ ID NO: 2801 and three CDRs of a light chain variable region set forth as SEQ ID NO: 2802; or (c-xiv) three CDRs of a heavy chain variable region set forth as SEQ ID NO: 2803 and three CDRs of a light chain variable region set forth as SEQ ID NO: 2804; or (d-xiv) three CDRs of a heavy chain variable region set forth as SEQ ID NO: 2805 and three CDRs of a light chain variable region set forth as SEQ ID NO: 2806; or (e-xiv) three CDRs of a heavy chain variable region set forth as SEQ ID NO: 2807 and three CDRs of a light chain variable region set forth as SEQ ID NO: 2808; or (f-xiv) three CDRs of a heavy chain variable region set forth as SEQ ID NO: 2809 and three CDRs of a light chain variable region set forth as SEQ ID NO: 2810; or (g-xiv) three CDRs of a heavy chain variable region set forth as SEQ ID NO: 2811 and three CDRs of a light chain variable region set forth as SEQ ID NO: 2812; or (h-xiv) three CDRs of a heavy chain variable region set forth as SEQ ID NO: 2813 and three CDRs of a light chain variable region set forth as SEQ ID NO: 2814; or (i-xiv) three CDRs of a heavy chain variable region set forth as SEQ ID NO: 2815 and three CDRs of a light chain variable region set forth as SEQ ID NO: 2816; or (j-xiv) three CDRs of a heavy chain variable region set forth as SEQ ID NO: 2817 and three CDRs of a light chain variable region set forth as SEQ ID NO: 2818; or (k-xiv) three CDRs of a heavy chain variable region set forth as SEQ ID NO: 2819 and three CDRs of a light chain variable region set forth as SEQ ID NO: 2820; or (l-xiv) three CDRs of a heavy chain variable region set forth as SEQ ID NO: 2821 and three CDRs of a light chain variable region set forth as SEQ ID NO: 2822; or (m-xiv) three CDRs of a heavy chain variable region set forth as SEQ ID NO: 2823 and three CDRs of a light chain variable region set forth as SEQ ID NO: 2824; or (n-xiv) three CDRs of a heavy chain variable region set forth as SEQ ID NO: 2825 and three CDRs of a light chain variable region set forth as SEQ ID NO: 2826; or (o-xiv) three CDRs of a heavy chain variable region set forth as SEQ ID NO: 2827 and three CDRs of a light chain variable region set forth as SEQ ID NO: 2828; or (p-xiv) three CDRs of a heavy chain variable region set forth as SEQ ID NO: 2829 and three CDRs of a light chain variable region set forth as SEQ ID NO: 2830; or (q-xiv) three CDRs of a heavy chain variable region set forth as SEQ ID NO: 2831 and three CDRs of a light chain variable region set forth as SEQ ID NO: 2832; or (r-xiv) three CDRs of a heavy chain variable region set forth as SEQ ID NO: 2833 and three CDRs of a light chain variable region set forth as SEQ ID NO: 2834; or (s-xiv) three CDRs of a heavy chain variable region set forth as SEQ ID NO: 2835 and three CDRs of a light chain variable region set forth as SEQ ID NO: 2836; or (t-xiv) three CDRs of a heavy chain variable region set forth as SEQ ID NO: 2837 and three CDRs of a light chain variable region set forth as SEQ ID NO: 2838; or (u-xiv) three CDRs of a heavy chain variable region set forth as SEQ ID NO: 2839 and three CDRs of a light chain variable region set forth as SEQ ID NO: 2840; or (v-xiv) three CDRs of a heavy chain variable region set forth as SEQ ID NO: 2841 and three CDRs of a light chain variable region set forth as SEQ ID NO: 2842; or (w-xiv) three CDRs of a heavy chain variable region set forth as SEQ ID NO: 2843 and three CDRs of a light chain variable region set forth as SEQ ID NO: 2844; or (x-xiv) three CDRs of a heavy chain variable region set forth as SEQ ID NO: 2845 and three CDRs of a light chain variable region set forth as SEQ ID NO: 2846; or (y-xiv) three CDRs of a heavy chain variable region set forth as SEQ ID NO: 2847 and three CDRs of a light chain variable region set forth as SEQ ID NO: 2848; or (z-xiv) three CDRs of a heavy chain variable region set forth as SEQ ID NO: 2849 and three CDRs of a light chain variable region set forth as SEQ ID NO: 2850; or (a-xv) three CDRs of a heavy chain variable region set forth as SEQ ID NO: 2851 and three CDRs of a light chain variable region set forth as SEQ ID NO: 2852; or (b-xv) three CDRs of a heavy chain variable region set forth as SEQ ID NO: 2853 and three CDRs of a light chain variable region set forth as SEQ ID NO: 2854; or (c-xv) three CDRs of a heavy chain variable region set forth as SEQ ID NO: 2855 and three CDRs of a light chain variable region set forth as SEQ ID NO: 2856; or (d-xv) three CDRs of a heavy chain variable region set forth as SEQ ID NO: 2857 and three CDRs of a light chain variable region set forth as SEQ ID NO: 2858; or (e-xv) three CDRs of a heavy chain variable region set forth as SEQ ID NO: 2859 and three CDRs of a light chain variable region set forth as SEQ ID NO: 2860; or (f-xv) three CDRs of a heavy chain variable region set forth as SEQ ID NO: 2861 and three CDRs of a light chain variable region set forth as SEQ ID NO: 2862; or (g-xv) three CDRs of a heavy chain variable region set forth as SEQ ID NO: 2863 and three CDRs of a light chain variable region set forth as SEQ ID NO: 2864; or (h-xv) three CDRs of a heavy chain variable region set forth as SEQ ID NO: 2865 and three CDRs of a light chain variable region set forth as SEQ ID NO: 2866; or (i-xv) three CDRs of a heavy chain variable region set forth as SEQ ID NO: 2867 and three CDRs of a light chain variable region set forth as SEQ ID NO: 2868; or (j-xv) three CDRs of a heavy chain variable region set forth as SEQ ID NO: 2869 and three CDRs of a light chain variable region set forth as SEQ ID NO: 2870; or (k-xv) three CDRs of a heavy chain variable region set forth as SEQ ID NO: 2871 and three CDRs of a light chain variable region set forth as SEQ ID NO: 2872; or (l-xv) three CDRs of a heavy chain variable region set forth as SEQ ID NO: 2873 and three CDRs of a light chain variable region set forth as SEQ ID NO: 2874; or (m-xv) three CDRs of a heavy chain variable region set forth as SEQ ID NO: 2875 and three CDRs of a light chain variable region set forth as SEQ ID NO: 2876; or (n-xv) three CDRs of a heavy chain variable region set forth as SEQ ID NO: 2877 and three CDRs of a light chain variable region set forth as SEQ ID NO: 2878; or (o-xv) three CDRs of a heavy chain variable region set forth as SEQ ID NO: 2879 and three CDRs of a light chain variable region set forth as SEQ ID NO: 2880; or (p-xv) three CDRs of a heavy chain variable region set forth as SEQ ID NO: 2881 and three CDRs of a light chain variable region set forth as SEQ ID NO: 2882; or (q-xv) three CDRs of a heavy chain variable region set forth as SEQ ID NO: 2883 and three CDRs of a light chain variable region set forth as SEQ ID NO: 2884; or (r-xv) three CDRs of a heavy chain variable region set forth as SEQ ID NO: 2885 and three CDRs of a light chain variable region set forth as SEQ ID NO: 2886; or (s-xv) three CDRs of a heavy chain variable region set forth as SEQ ID NO: 2887 and three CDRs of a light chain variable region set forth as SEQ ID NO: 2888; or (t-xv) three CDRs of a heavy chain variable region set forth as SEQ ID NO: 2889 and three CDRs of a light chain variable region set forth as SEQ ID NO: 2890; or (u-xv) three CDRs of a heavy chain variable region set forth as SEQ ID NO: 2891 and three CDRs of a light chain variable region set forth as SEQ ID NO: 2892; or (v-xv) three CDRs of a heavy chain variable region set forth as SEQ ID NO: 2893 and three CDRs of a light chain variable region set forth as SEQ ID NO: 2894; or (w-xv) three CDRs of a heavy chain variable region set forth as SEQ ID NO: 2895 and three CDRs of a light chain variable region set forth as SEQ ID NO: 2896; or (x-xv) three CDRs of a heavy chain variable region set forth as SEQ ID NO: 2897 and three CDRs of a light chain variable region set forth as SEQ ID NO: 2898; or (y-xv) three CDRs of a heavy chain variable region set forth as SEQ ID NO: 2899 and three CDRs of a light chain variable region set forth as SEQ ID NO: 2900; or (z-xv) three CDRs of a heavy chain variable region set forth as SEQ ID NO: 2901 and three CDRs of a light chain variable region set forth as SEQ ID NO: 2902; or (a-xvi) three CDRs of a heavy chain variable region set forth as SEQ ID NO: 2903 and three CDRs of a light chain variable region set forth as SEQ ID NO: 2904; or (b-xvi) three CDRs of a heavy chain variable region set forth as SEQ ID NO: 2905 and three CDRs of a light chain variable region set forth as SEQ ID NO: 2906; or (c-xvi) three CDRs of a heavy chain variable region set forth as SEQ ID NO: 2907 and three CDRs of a light chain variable region set forth as SEQ ID NO: 2908; or (d-xvi) three CDRs of a heavy chain variable region set forth as SEQ ID NO: 2909 and three CDRs of a light chain variable region set forth as SEQ ID NO: 2910; or (e-xvi) three CDRs of a heavy chain variable region set forth as SEQ ID NO: 2911 and three CDRs of a light chain variable region set forth as SEQ ID NO: 2912; or (f-xvi) three CDRs of a heavy chain variable region set forth as SEQ ID NO: 2913 and three CDRs of a light chain variable region set forth as SEQ ID NO: 2914; or (g-xvi) three CDRs of a heavy chain variable region set forth as SEQ ID NO: 2915 and three CDRs of a light chain variable region set forth as SEQ ID NO: 2916; or (h-xvi) three CDRs of a heavy chain variable region set forth as SEQ ID NO: 2917 and three CDRs of a light chain variable region set forth as SEQ ID NO: 2918; or (i-xvi) three CDRs of a heavy chain variable region set forth as SEQ ID NO: 2919 and three CDRs of a light chain variable region set forth as SEQ ID NO: 2920; or (j-xvi) three CDRs of a heavy chain variable region set forth as SEQ ID NO: 2921 and three CDRs of a light chain variable region set forth as SEQ ID NO: 2922; or (k-xvi) three CDRs of a heavy chain variable region set forth as SEQ ID NO: 2923 and three CDRs of a light chain variable region set forth as SEQ ID NO: 2924; or (l-xvi) three CDRs of a heavy chain variable region set forth as SEQ ID NO: 2925 and three CDRs of a light chain variable region set forth as SEQ ID NO: 2926; or (m-xvi) three CDRs of a heavy chain variable region set forth as SEQ ID NO: 2927 and three CDRs of a light chain variable region set forth as SEQ ID NO: 2928; or (n-xvi) three CDRs of a heavy chain variable region set forth as SEQ ID NO: 2929 and three CDRs of a light chain variable region set forth as SEQ ID NO: 2930; or (o-xvi) three CDRs of a heavy chain variable region set forth as SEQ ID NO: 2931 and three CDRs of a light chain variable region set forth as SEQ ID NO: 2932; or (p-xvi) three CDRs of a heavy chain variable region set forth as SEQ ID NO: 2933 and three CDRs of a light chain variable region set forth as SEQ ID NO: 2934; or (q-xvi) three CDRs of a heavy chain variable region set forth as SEQ ID NO: 2935 and three CDRs of a light chain variable region set forth as SEQ ID NO: 2936; or (r-xvi) three CDRs of a heavy chain variable region set forth as SEQ ID NO: 2937 and three CDRs of a light chain variable region set forth as SEQ ID NO: 2938; or (s-xvi) three CDRs of a heavy chain variable region set forth as SEQ ID NO: 2939 and three CDRs of a light chain variable region set forth as SEQ ID NO: 2940; or (y-xvi) three CDRs of a heavy chain variable region set forth as SEQ ID NO: 2941 and three CDRs of a light chain variable region set forth as SEQ ID NO: 2942; or (u-xvi) three CDRs of a heavy chain variable region set forth as SEQ ID NO: 2943 and three CDRs of a light chain variable region set forth as SEQ ID NO: 2944; or (v-xvi) three CDRs of a heavy chain variable region set forth as SEQ ID NO: 2945 and three CDRs of a light chain variable region set forth as SEQ ID NO: 2946; or (w-xvi) three CDRs of a heavy chain variable region set forth as SEQ ID NO: 2947 and three CDRs of a light chain variable region set forth as SEQ ID NO: 2948; or (x-xvi) three CDRs of a heavy chain variable region set forth as SEQ ID NO: 2949 and three CDRs of a light chain variable region set forth as SEQ ID NO: 2950; or (y-xvi) three CDRs of a heavy chain variable region set forth as SEQ ID NO: 2951 and three CDRs of a light chain variable region set forth as SEQ ID NO: 2952; or (z-xvi) three CDRs of a heavy chain variable region set forth as SEQ ID NO: 2953 and three CDRs of a light chain variable region set forth as SEQ ID NO: 2954; or (a-xvii) three CDRs of a heavy chain variable region set forth as SEQ ID NO: 2955 and three CDRs of a light chain variable region set forth as SEQ ID NO: 2956; or (b-xvii) three CDRs of a heavy chain variable region set forth as SEQ ID NO: 2957 and three CDRs of a light chain variable region set forth as SEQ ID NO: 2958; or (c-xvii) three CDRs of a heavy chain variable region set forth as SEQ ID NO: 2959 and three CDRs of a light chain variable region set forth as SEQ ID NO: 2960; or (d-xvii) three CDRs of a heavy chain variable region set forth as SEQ ID NO: 2961 and three CDRs of a light chain variable region set forth as SEQ ID NO: 2962; or (e-xvii) three CDRs of a heavy chain variable region set forth as SEQ ID NO: 2963 and three CDRs of a light chain variable region set forth as SEQ ID NO: 2964; or (f-xvii) three CDRs of a heavy chain variable region set forth as SEQ ID NO: 2965 and three CDRs of a light chain variable region set forth as SEQ ID NO: 2966; or (g-xvii) three CDRs of a heavy chain variable region set forth as SEQ ID NO: 2967 and three CDRs of a light chain variable region set forth as SEQ ID NO: 2968; or (h-xvii) three CDRs of a heavy chain variable region set forth as SEQ ID NO: 2969 and three CDRs of a light chain variable region set forth as SEQ ID NO: 2970; or (i-xvii) three CDRs of a heavy chain variable region set forth as SEQ ID NO: 2971 and three CDRs of a light chain variable region set forth as SEQ ID NO: 2972; or (j-xvii) three CDRs of a heavy chain variable region set forth as SEQ ID NO: 2973 and three CDRs of a light chain variable region set forth as SEQ ID NO: 2974; or (k-xvii) three CDRs of a heavy chain variable region set forth as SEQ ID NO: 2975 and three CDRs of a light chain variable region set forth as SEQ ID NO: 2976; or (l-xvii) three CDRs of a heavy chain variable region set forth as SEQ ID NO: 2977 and three CDRs of a light chain variable region set forth as SEQ ID NO: 2978; or (m-xvii) three CDRs of a heavy chain variable region set forth as SEQ ID NO: 2979 and three CDRs of a light chain variable region set forth as SEQ ID NO: 2980; or (n-xvii) three CDRs of a heavy chain variable region set forth as SEQ ID NO: 2981 and three CDRs of a light chain variable region set forth as SEQ ID NO: 2982; or (o-xvii) three CDRs of a heavy chain variable region set forth as SEQ ID NO: 2983 and three CDRs of a light chain variable region set forth as SEQ ID NO: 2984; or (p-xvii) three CDRs of a heavy chain variable region set forth as SEQ ID NO: 2985 and three CDRs of a light chain variable region set forth as SEQ ID NO: 2986; or (q-xvii) three CDRs of a heavy chain variable region set forth as SEQ ID NO: 2987 and three CDRs of a light chain variable region set forth as SEQ ID NO: 2988; or (r-xvii) three CDRs of a heavy chain variable region set forth as SEQ ID NO: 2989 and three CDRs of a light chain variable region set forth as SEQ ID NO: 2990; or (s-xvii) three CDRs of a heavy chain variable region set forth as SEQ ID NO: 2991 and three CDRs of a light chain variable region set forth as SEQ ID NO: 2992; or (t-xvii) three CDRs of a heavy chain variable region set forth as SEQ ID NO: 2993 and three CDRs of a light chain variable region set forth as SEQ ID NO: 2994; or (u-xvii) three CDRs of a heavy chain variable region set forth as SEQ ID NO: 2995 and three CDRs of a light chain variable region set forth as SEQ ID NO: 2996; or (v-xvii) three CDRs of a heavy chain variable region set forth as SEQ ID NO: 2997 and three CDRs of a light chain variable region set forth as SEQ ID NO: 2998; or (w-xvii) three CDRs of a heavy chain variable region set forth as SEQ ID NO: 2999 and three CDRs of a light chain variable region set forth as SEQ ID NO: 3000; or (x-xvii) three CDRs of a heavy chain variable region set forth as SEQ ID NO: 3001 and three CDRs of a light chain variable region set forth as SEQ ID NO: 3002; or (y-xvii) three CDRs of a heavy chain variable region set forth as SEQ ID NO: 3003 and three CDRs of a light chain variable region set forth as SEQ ID NO: 3004; or (z-xvii) three CDRs of a heavy chain variable region set forth as SEQ ID NO: 3005 and three CDRs of a light chain variable region set forth as SEQ ID NO: 3006; or (a-xviii) three CDRs of a heavy chain variable region set forth as SEQ ID NO: 3007 and three CDRs of a light chain variable region set forth as SEQ ID NO: 3008; or (b-xviii) three CDRs of a heavy chain variable region set forth as SEQ ID NO: 3009 and three CDRs of a light chain variable region set forth as SEQ ID NO: 3010; or (c-xviii) three CDRs of a heavy chain variable region set forth as SEQ ID NO: 3011 and three CDRs of a light chain variable region set forth as SEQ ID NO: 3012; or (d-xviii) three CDRs of a heavy chain variable region set forth as SEQ ID NO: 3013 and three CDRs of a light chain variable region set forth as SEQ ID NO: 3014; or (e-xviii) three CDRs of a heavy chain variable region set forth as SEQ ID NO: 3015 and three CDRs of a light chain variable region set forth as SEQ ID NO: 3016; or (f-xviii) three CDRs of a heavy chain variable region set forth as SEQ ID NO: 3017 and three CDRs of a light chain variable region set forth as SEQ ID NO: 3018; or (j-xviii) three CDRs of a heavy chain variable region set forth as SEQ ID NO: 3019 and three CDRs of a light chain variable region set forth as SEQ ID NO: 3020; or (g-xviii) three CDRs of a heavy chain variable region set forth as SEQ ID NO: 3021 and three CDRs of a light chain variable region set forth as SEQ ID NO: 3022; or (h-xviii) three CDRs of a heavy chain variable region set forth as SEQ ID NO: 3023 and three CDRs of a light chain variable region set forth as SEQ ID NO: 3024; or (i-xviii) three CDRs of a heavy chain variable region set forth as SEQ ID NO: 3025 and three CDRs of a light chain variable region set forth as SEQ ID NO: 3026; or (j-xviii) three CDRs of a heavy chain variable region set forth as SEQ ID NO: 3027 and three CDRs of a light chain variable region set forth as SEQ ID NO: 3028; or (k-xviii) three CDRs of a heavy chain variable region set forth as SEQ ID NO: 3029 and three CDRs of a light chain variable region set forth as SEQ ID NO: 3030; or (l-xviii) three CDRs of a heavy chain variable region set forth as SEQ ID NO: 3031 and three CDRs of a light chain variable region set forth as SEQ ID NO: 3032; or (m-xviii) three CDRs of a heavy chain variable region set forth as SEQ ID NO: 3033 and three CDRs of a light chain variable region set forth as SEQ ID NO: 3034; or (n-xviii) three CDRs of a heavy chain variable region set forth as SEQ ID NO: 3035 and three CDRs of a light chain variable region set forth as SEQ ID NO: 3036; or (o-xviii) three CDRs of a heavy chain variable region set forth as SEQ ID NO: 3037 and three CDRs of a light chain variable region set forth as SEQ ID NO: 3038; or (p-xviii) three CDRs of a heavy chain variable region set forth as SEQ ID NO: 3039 and three CDRs of a light chain variable region set forth as SEQ ID NO: 3040; or (q-xviii) three CDRs of a heavy chain variable region set forth as SEQ ID NO: 3041 and three CDRs of a light chain variable region set forth as SEQ ID NO: 3042; or (r-xviii) three CDRs of a heavy chain variable region set forth as SEQ ID NO: 3043 and three CDRs of a light chain variable region set forth as SEQ ID NO: 3044; or (s-xviii) three CDRs of a heavy chain variable region set forth as SEQ ID NO: 3045 and three CDRs of a light chain variable region set forth as SEQ ID NO: 3046; or (t-xviii) three CDRs of a heavy chain variable region set forth as SEQ ID NO: 3047 and three CDRs of a light chain variable region set forth as SEQ ID NO: 3048; or (u-xviii) three CDRs of a heavy chain variable region set forth as SEQ ID NO: 3049 and three CDRs of a light chain variable region set forth as SEQ ID NO: 3050; or (v-xviii) three CDRs of a heavy chain variable region set forth as SEQ ID NO: 3051 and three CDRs of a light chain variable region set forth as SEQ ID NO: 3052; or (w-xviii) three CDRs of a heavy chain variable region set forth as SEQ ID NO: 3053 and three CDRs of a light chain variable region set forth as SEQ ID NO: 3054; or (x-xviii) three CDRs of a heavy chain variable region set forth as SEQ ID NO: 3055 and three CDRs of a light chain variable region set forth as SEQ ID NO: 3056; or (y-xviii) three CDRs of a heavy chain variable region set forth as SEQ ID NO: 3057 and three CDRs of a light chain variable region set forth as SEQ ID NO: 3058; or (z-xviii) three CDRs of a heavy chain variable region set forth as SEQ ID NO: 3059 and three CDRs of a light chain variable region set forth as SEQ ID NO: 3060; or (a-xix) three CDRs of a heavy chain variable region set forth as SEQ ID NO: 3061 and three CDRs of a light chain variable region set forth as SEQ ID NO: 3062; or (b-xix) three CDRs of a heavy chain variable region set forth as SEQ ID NO: 3063 and three CDRs of a light chain variable region set forth as SEQ ID NO: 3064; or (c-xix) three CDRs of a heavy chain variable region set forth as SEQ ID NO: 3065 and three CDRs of a light chain variable region set forth as SEQ ID NO: 3066; or (d-xix) three CDRs of a heavy chain variable region set forth as SEQ ID NO: 3067 and three CDRs of a light chain variable region set forth as SEQ ID NO: 3068; or (e-xix) three CDRs of a heavy chain variable region set forth as SEQ ID NO: 3069 and three CDRs of a light chain variable region set forth as SEQ ID NO: 3070; or (f-xix) three CDRs of a heavy chain variable region set forth as SEQ ID NO: 3071 and three CDRs of a light chain variable region set forth as SEQ ID NO: 3072; or (g-xix) three CDRs of a heavy chain variable region set forth as SEQ ID NO: 3073 and three CDRs of a light chain variable region set forth as SEQ ID NO: 3074; or (h-xix) three CDRs of a heavy chain variable region set forth as SEQ ID NO: 3075 and three CDRs of a light chain variable region set forth as SEQ ID NO: 3076; or (i-xix) three CDRs of a heavy chain variable region set forth as SEQ ID NO: 3077 and three CDRs of a light chain variable region set forth as SEQ ID NO: 3078; or (j-xix) three CDRs of a heavy chain variable region set forth as SEQ ID NO: 3079 and three CDRs of a light chain variable region set forth as SEQ ID NO: 3080; or (k-xix) three CDRs of a heavy chain variable region set forth as SEQ ID NO: 3081 and three CDRs of a light chain variable region set forth as SEQ ID NO: 3082; or (l-xix) three CDRs of a heavy chain variable region set forth as SEQ ID NO: 3083 and three CDRs of a light chain variable region set forth as SEQ ID NO: 3084; or (m-xix) three CDRs of a heavy chain variable region set forth as SEQ ID NO: 3085 and three CDRs of a light chain variable region set forth as SEQ ID NO: 3086; or (n-xix) three CDRs of a heavy chain variable region set forth as SEQ ID NO: 3087 and three CDRs of a light chain variable region set forth as SEQ ID NO: 3088; or (o-xix) three CDRs of a heavy chain variable region set forth as SEQ ID NO: 3089 and three CDRs of a light chain variable region set forth as SEQ ID NO: 3090; or (p-xix) three CDRs of a heavy chain variable region set forth as SEQ ID NO: 3091 and three CDRs of a light chain variable region set forth as SEQ ID NO: 3092; or (q-xix) three CDRs of a heavy chain variable region set forth as SEQ ID NO: 3093 and three CDRs of a light chain variable region set forth as SEQ ID NO: 3094; or (r-xix) three CDRs of a heavy chain variable region set forth as SEQ ID NO: 3095 and three CDRs of a light chain variable region set forth as SEQ ID NO: 3096; or (s-xix) three CDRs of a heavy chain variable region set forth as SEQ ID NO: 3097 and three CDRs of a light chain variable region set forth as SEQ ID NO: 3098; or (t-xix) three CDRs of a heavy chain variable region set forth as SEQ ID NO: 3099 and three CDRs of a light chain variable region set forth as SEQ ID NO: 3100; or (u-xix) three CDRs of a heavy chain variable region set forth as SEQ ID NO: 3101 and three CDRs of a light chain variable region set forth as SEQ ID NO: 3102; or (v-xix) three CDRs of a heavy chain variable region set forth as SEQ ID NO: 3103 and three CDRs of a light chain variable region set forth as SEQ ID NO: 3104; or (w-xix) three CDRs of a heavy chain variable region set forth as SEQ ID NO: 3105 and three CDRs of a light chain variable region set forth as SEQ ID NO: 3106; or (x-xix) three CDRs of a heavy chain variable region set forth as SEQ ID NO: 3107 and three CDRs of a light chain variable region set forth as SEQ ID NO: 3108; or (y-xix) three CDRs of a heavy chain variable region set forth as SEQ ID NO: 3109 and three CDRs of a light chain variable region set forth as SEQ ID NO: 3110; or (z-xix) three CDRs of a heavy chain variable region set forth as SEQ ID NO: 3111 and three CDRs of a light chain variable region set forth as SEQ ID NO: 3112; or (a-xx) three CDRs of a heavy chain variable region set forth as SEQ ID NO: 3113 and three CDRs of a light chain variable region set forth as SEQ ID NO: 3114; or (b-xx) three CDRs of a heavy chain variable region set forth as SEQ ID NO: 3115 and three CDRs of a light chain variable region set forth as SEQ ID NO: 3116; or (c-xx) three CDRs of a heavy chain variable region set forth as SEQ ID NO: 3117 and three CDRs of a light chain variable region set forth as SEQ ID NO: 3118; or (d-xx) three CDRs of a heavy chain variable region set forth as SEQ ID NO: 3119 and three CDRs of a light chain variable region set forth as SEQ ID NO: 3120; or (e-xx) three CDRs of a heavy chain variable region set forth as SEQ ID NO: 3121 and three CDRs of a light chain variable region set forth as SEQ ID NO: 3122; or (f-xx) three CDRs of a heavy chain variable region set forth as SEQ ID NO: 3123 and three CDRs of a light chain variable region set forth as SEQ ID NO: 3124; or (g-xx) three CDRs of a heavy chain variable region set forth as SEQ ID NO: 3125 and three CDRs of a light chain variable region set forth as SEQ ID NO: 3126; or (h-xx) three CDRs of a heavy chain variable region set forth as SEQ ID NO: 3127 and three CDRs of a light chain variable region set forth as SEQ ID NO: 3128; or (i-xx) three CDRs of a heavy chain variable region set forth as SEQ ID NO: 3129 and three CDRs of a light chain variable region set forth as SEQ ID NO: 3130; or (j-xx) three CDRs of a heavy chain variable region set forth as SEQ ID NO: 3131 and three CDRs of a light chain variable region set forth as SEQ ID NO: 3132; or (k-xx) three CDRs of a heavy chain variable region set forth as SEQ ID NO: 3133 and three CDRs of a light chain variable region set forth as SEQ ID NO: 3134; or (l-xx) three CDRs of a heavy chain variable region set forth as SEQ ID NO: 3135 and three CDRs of a light chain variable region set forth as SEQ ID NO: 3136; or (m-xx) three CDRs of a heavy chain variable region set forth as SEQ ID NO: 3137 and three CDRs of a light chain variable region set forth as SEQ ID NO: 3138; or (n-xx) three CDRs of a heavy chain variable region set forth as SEQ ID NO: 3139 and three CDRs of a light chain variable region set forth as SEQ ID NO: 3140; or (o-xx) three CDRs of a heavy chain variable region set forth as SEQ ID NO: 3141 and three CDRs of a light chain variable region set forth as SEQ ID NO: 3142; or (p-xx) three CDRs of a heavy chain variable region set forth as SEQ ID NO: 3143 and three CDRs of a light chain variable region set forth as SEQ ID NO: 3144; or (q-xx) three CDRs of a heavy chain variable region set forth as SEQ ID NO: 3145 and three CDRs of a light chain variable region set forth as SEQ ID NO: 3146; or (r-xx) three CDRs of a heavy chain variable region set forth as SEQ ID NO: 3147 and three CDRs of a light chain variable region set forth as SEQ ID NO: 3148; or (s-xx) three CDRs of a heavy chain variable region set forth as SEQ ID NO: 3149 and three CDRs of a light chain variable region set forth as SEQ ID NO: 3150; or (t-xx) three CDRs of a heavy chain variable region set forth as SEQ ID NO: 3151 and three CDRs of a light chain variable region set forth as SEQ ID NO: 3152; or (u-xx) three CDRs of a heavy chain variable region set forth as SEQ ID NO: 3153 and three CDRs of a light chain variable region set forth as SEQ ID NO: 3154; or (v-xx) three CDRs of a heavy chain variable region set forth as SEQ ID NO: 3155 and three CDRs of a light chain variable region set forth as SEQ ID NO: 3156; or (w-xx) three CDRs of a heavy chain variable region set forth as SEQ ID NO: 3157 and three CDRs of a light chain variable region set forth as SEQ ID NO: 3158; or (x-xx) three CDRs of a heavy chain variable region set forth as SEQ ID NO: 3159 and three CDRs of a light chain variable region set forth as SEQ ID NO: 3160; or (y-xx) three CDRs of a heavy chain variable region set forth as SEQ ID NO: 3161 and three CDRs of a light chain variable region set forth as SEQ ID NO: 3162; or (z-xx) three CDRs of a heavy chain variable region set forth as SEQ ID NO: 3163 and three CDRs of a light chain variable region set forth as SEQ ID NO: 3164; or (a-xxi) three CDRs of a heavy chain variable region set forth as SEQ ID NO: 3165 and three CDRs of a light chain variable region set forth as SEQ ID NO: 3166; or (b-xxi) three CDRs of a heavy chain variable region set forth as SEQ ID NO: 3167 and three CDRs of a light chain variable region set forth as SEQ ID NO: 3168; or (c-xxi) three CDRs of a heavy chain variable region set forth as SEQ ID NO: 3169 and three CDRs of a light chain variable region set forth as SEQ ID NO: 3170; or (d-xxi) three CDRs of a heavy chain variable region set forth as SEQ ID NO: 3171 and three CDRs of a light chain variable region set forth as SEQ ID NO: 3172; or (e-xxi) three CDRs of a heavy chain variable region set forth as SEQ ID NO: 3173 and three CDRs of a light chain variable region set forth as SEQ ID NO: 3174; or (f-xxi) three CDRs of a heavy chain variable region set forth as SEQ ID NO: 3175 and three CDRs of a light chain variable region set forth as SEQ ID NO: 3176; or (g-xxi) three CDRs of a heavy chain variable region set forth as SEQ ID NO: 3177 and three CDRs of a light chain variable region set forth as SEQ ID NO: 3178; or (h-xxi) three CDRs of a heavy chain variable region set forth as SEQ ID NO: 3179 and three CDRs of a light chain variable region set forth as SEQ ID NO: 3180; or (i-xxi) three CDRs of a heavy chain variable region set forth as SEQ ID NO: 3181 and three CDRs of a light chain variable region set forth as SEQ ID NO: 3182; or (j-xxi) three CDRs of a heavy chain variable region set forth as SEQ ID NO: 3183 and three CDRs of a light chain variable region set forth as SEQ ID NO: 3184; or (k-xxi) three CDRs of a heavy chain variable region set forth as SEQ ID NO: 3185 and three CDRs of a light chain variable region set forth as SEQ ID NO: 3186; or (l-xxi) three CDRs of a heavy chain variable region set forth as SEQ ID NO: 3187 and three CDRs of a light chain variable region set forth as SEQ ID NO: 3188; or (m-xxi) three CDRs of a heavy chain variable region set forth as SEQ ID NO: 3189 and three CDRs of a light chain variable region set forth as SEQ ID NO: 3190; or (n-xxi) three CDRs of a heavy chain variable region set forth as SEQ ID NO: 3191 and three CDRs of a light chain variable region set forth as SEQ ID NO: 3192; or (o-xxi) three CDRs of a heavy chain variable region set forth as SEQ ID NO: 3193 and three CDRs of a light chain variable region set forth as SEQ ID NO: 3194; or (p-xxi) three CDRs of a heavy chain variable region set forth as SEQ ID NO: 3195 and three CDRs of a light chain variable region set forth as SEQ ID NO: 3196; or (q-xxi) three CDRs of a heavy chain variable region set forth as SEQ ID NO: 3197 and three CDRs of a light chain variable region set forth as SEQ ID NO: 3198; or (r-xxi) three CDRs of a heavy chain variable region set forth as SEQ ID NO: 3199 and three CDRs of a light chain variable region set forth as SEQ ID NO: 3200; or (s-xxi) three CDRs of a heavy chain variable region set forth as SEQ ID NO: 3201 and three CDRs of a light chain variable region set forth as SEQ ID NO: 3202; or (t-xxi) three CDRs of a heavy chain variable region set forth as SEQ ID NO: 3203 and three CDRs of a light chain variable region set forth as SEQ ID NO: 3204; or (u-xxi) three CDRs of a heavy chain variable region set forth as SEQ ID NO: 3205 and three CDRs of a light chain variable region set forth as SEQ ID NO: 3206; or (v-xxi) three CDRs of a heavy chain variable region set forth as SEQ ID NO: 3207 and three CDRs of a light chain variable region set forth as SEQ ID NO: 3208; or (w-xxi) three CDRs of a heavy chain variable region set forth as SEQ ID NO: 3209 and three CDRs of a light chain variable region set forth as SEQ ID NO: 3210; or (x-xxi) three CDRs of a heavy chain variable region set forth as SEQ ID NO: 3211 and three CDRs of a light chain variable region set forth as SEQ ID NO: 3212; or (y-xxi) three CDRs of a heavy chain variable region set forth as SEQ ID NO: 3213 and three CDRs of a light chain variable region set forth as SEQ ID NO: 3214; or (z-xxi) three CDRs of a heavy chain variable region set forth as SEQ ID NO: 3215 and three CDRs of a light chain variable region set forth as SEQ ID NO: 3216; or (a-xxii) three CDRs of a heavy chain variable region set forth as SEQ ID NO: 3217 and three CDRs of a light chain variable region set forth as SEQ ID NO: 3218; or (b-xxii) three CDRs of a heavy chain variable region set forth as SEQ ID NO: 3219 and three CDRs of a light chain variable region set forth as SEQ ID NO: 3220; or (c-xxii) three CDRs of a heavy chain variable region set forth as SEQ ID NO: 3221 and three CDRs of a light chain variable region set forth as SEQ ID NO: 3222; or (d-xxii) three CDRs of a heavy chain variable region set forth as SEQ ID NO: 3223 and three CDRs of a light chain variable region set forth as SEQ ID NO: 3224; or (e-xxii) three CDRs of a heavy chain variable region set forth as SEQ ID NO: 3225 and three CDRs of a light chain variable region set forth as SEQ ID NO: 3226; or (f-xxii) three CDRs of a heavy chain variable region set forth as SEQ ID NO: 3227 and three CDRs of a light chain variable region set forth as SEQ ID NO: 3228; or (g-xxii) three CDRs of a heavy chain variable region set forth as SEQ ID NO: 3229 and three CDRs of a light chain variable region set forth as SEQ ID NO: 3230; or (h-xxii) three CDRs of a heavy chain variable region set forth as SEQ ID NO: 3231 and three CDRs of a light chain variable region set forth as SEQ ID NO: 3232; or (i-xxii) three CDRs of a heavy chain variable region set forth as SEQ ID NO: 3233 and three CDRs of a light chain variable region set forth as SEQ ID NO: 3234; or (j-xxii) three CDRs of a heavy chain variable region set forth as SEQ ID NO: 3235 and three CDRs of a light chain variable region set forth as SEQ ID NO: 3236; or (k-xxii) three CDRs of a heavy chain variable region set forth as SEQ ID NO: 3237 and three CDRs of a light chain variable region set forth as SEQ ID NO: 3238; or (l-xxii) three CDRs of a heavy chain variable region set forth as SEQ ID NO: 3239 and three CDRs of a light chain variable region set forth as SEQ ID NO: 3240; or (m-xxii) three CDRs of a heavy chain variable region set forth as SEQ ID NO: 3241 and three CDRs of a light chain variable region set forth as SEQ ID NO: 3242; or (n-xxii) three CDRs of a heavy chain variable region set forth as SEQ ID NO: 3243 and three CDRs of a light chain variable region set forth as SEQ ID NO: 3244; or (o-xxii) three CDRs of a heavy chain variable region set forth as SEQ ID NO: 3245 and three CDRs of a light chain variable region set forth as SEQ ID NO: 3246; or (p-xxii) three CDRs of a heavy chain variable region set forth as SEQ ID NO: 3247 and three CDRs of a light chain variable region set forth as SEQ ID NO: 3248; or (q-xxii) three CDRs of a heavy chain variable region set forth as SEQ ID NO: 3249 and three CDRs of a light chain variable region set forth as SEQ ID NO: 3250; or (r-xxii) three CDRs of a heavy chain variable region set forth as SEQ ID NO: 3251 and three CDRs of a light chain variable region set forth as SEQ ID NO: 3252; or (s-xxii) three CDRs of a heavy chain variable region set forth as SEQ ID NO: 3253 and three CDRs of a light chain variable region set forth as SEQ ID NO: 3254; or (t-xxii) three CDRs of a heavy chain variable region set forth as SEQ ID NO: 3255 and three CDRs of a light chain variable region set forth as SEQ ID NO: 3256; or (u-xxii) three CDRs of a heavy chain variable region set forth as SEQ ID NO: 3257 and three CDRs of a light chain variable region set forth as SEQ ID NO: 3258; or (v-xxii) three CDRs of a heavy chain variable region set forth as SEQ ID NO: 3259 and three CDRs of a light chain variable region set forth as SEQ ID NO: 3260; or (w-xxii) three CDRs of a heavy chain variable region set forth as SEQ ID NO: 3261 and three CDRs of a light chain variable region set forth as SEQ ID NO: 3262; or (x-xxii) three CDRs of a heavy chain variable region set forth as SEQ ID NO: 3263 and three CDRs of a light chain variable region set forth as SEQ ID NO: 3264; or (y-xxii) three CDRs of a heavy chain variable region set forth as SEQ ID NO: 3265 and three CDRs of a light chain variable region set forth as SEQ ID NO: 3266; or (z-xxii) three CDRs of a heavy chain variable region set forth as SEQ ID NO: 3267 and three CDRs of a light chain variable region set forth as SEQ ID NO: 3268; or (a-xxiii) three CDRs of a heavy chain variable region set forth as SEQ ID NO: 3269 and three CDRs of a light chain variable region set forth as SEQ ID NO: 3270; or (b-xxiii) three CDRs of a heavy chain variable region set forth as SEQ ID NO: 3271 and three CDRs of a light chain variable region set forth as SEQ ID NO: 3272; or (c-xxiii) three CDRs of a heavy chain variable region set forth as SEQ ID NO: 3273 and three CDRs of a light chain variable region set forth as SEQ ID NO: 3274; or (d-xxiii) three CDRs of a heavy chain variable region set forth as SEQ ID NO: 3275 and three CDRs of a light chain variable region set forth as SEQ ID NO: 3276; or (e-xxiii) three CDRs of a heavy chain variable region set forth as SEQ ID NO: 3277 and three CDRs of a light chain variable region set forth as SEQ ID NO: 3278; or (f-xxiii) three CDRs of a heavy chain variable region set forth as SEQ ID NO: 3279 and three CDRs of a light chain variable region set forth as SEQ ID NO: 3280; or (g-xxiii) three CDRs of a heavy chain variable region set forth as SEQ ID NO: 3281 and three CDRs of a light chain variable region set forth as SEQ ID NO: 3282; or (h-xxiii) three CDRs of a heavy chain variable region set forth as SEQ ID NO: 3283 and three CDRs of a light chain variable region set forth as SEQ ID NO: 3284; or (i-xxiii) three CDRs of a heavy chain variable region set forth as SEQ ID NO: 3285 and three CDRs of a light chain variable region set forth as SEQ ID NO: 3286; or (j-xxiii) three CDRs of a heavy chain variable region set forth as SEQ ID NO: 3287 and three CDRs of a light chain variable region set forth as SEQ ID NO: 3288; or (k-xxiii) three CDRs of a heavy chain variable region set forth as SEQ ID NO: 3289 and three CDRs of a light chain variable region set forth as SEQ ID NO: 3290; or (l-xxiii) three CDRs of a heavy chain variable region set forth as SEQ ID NO: 3291 and three CDRs of a light chain variable region set forth as SEQ ID NO: 3292; or (m-xxiii) three CDRs of a heavy chain variable region set forth as SEQ ID NO: 3293 and three CDRs of a light chain variable region set forth as SEQ ID NO: 3294; or (n-xxiii) three CDRs of a heavy chain variable region set forth as SEQ ID NO: 3295 and three CDRs of a light chain variable region set forth as SEQ ID NO: 3296; or (o-xxiii) three CDRs of a heavy chain variable region set forth as SEQ ID NO: 3297 and three CDRs of a light chain variable region set forth as SEQ ID NO: 3298; or (p-xxiii) three CDRs of a heavy chain variable region set forth as SEQ ID NO: 3299 and three CDRs of a light chain variable region set forth as SEQ ID NO: 3300; or (q-xxiii) three CDRs of a heavy chain variable region set forth as SEQ ID NO: 3301 and three CDRs of a light chain variable region set forth as SEQ ID NO: 3302; or (r-xxiii) three CDRs of a heavy chain variable region set forth as SEQ ID NO: 3303 and three CDRs of a light chain variable region set forth as SEQ ID NO: 3304; or (s-xxiii) three CDRs of a heavy chain variable region set forth as SEQ ID NO: 3305 and three CDRs of a light chain variable region set forth as SEQ ID NO: 3306; or (t-xxiii) three CDRs of a heavy chain variable region set forth as SEQ ID NO: 3307 and three CDRs of a light chain variable region set forth as SEQ ID NO: 3308; or (u-xxiii) three CDRs of a heavy chain variable region set forth as SEQ ID NO: 3309 and three CDRs of a light chain variable region set forth as SEQ ID NO: 3310; or (v-xxiii) three CDRs of a heavy chain variable region set forth as SEQ ID NO: 3311 and three CDRs of a light chain variable region set forth as SEQ ID NO: 3312; or (w-xxiii) three CDRs of a heavy chain variable region set forth as SEQ ID NO: 3313 and three CDRs of a light chain variable region set forth as SEQ ID NO: 3314; or (x-xxiii) three CDRs of a heavy chain variable region set forth as SEQ ID NO: 3315 and three CDRs of a light chain variable region set forth as SEQ ID NO: 3316; or (y-xxiii) three CDRs of a heavy chain variable region set forth as SEQ ID NO: 3317 and three CDRs of a light chain variable region set forth as SEQ ID NO: 3318; or (z-xxiii) three CDRs of a heavy chain variable region set forth as SEQ ID NO: 3319 and three CDRs of a light chain variable region set forth as SEQ ID NO: 3320; or (a-xxiv) three CDRs of a heavy chain variable region set forth as SEQ ID NO: 3321 and three CDRs of a light chain variable region set forth as SEQ ID NO: 3322; or (b-xxiv) three CDRs of a heavy chain variable region set forth as SEQ ID NO: 3323 and three CDRs of a light chain variable region set forth as SEQ ID NO: 3324; or (c-xxiv) three CDRs of a heavy chain variable region set forth as SEQ ID NO: 3325 and three CDRs of a light chain variable region set forth as SEQ ID NO: 3326; or (d-xxiv) three CDRs of a heavy chain variable region set forth as SEQ ID NO: 3327 and three CDRs of a light chain variable region set forth as SEQ ID NO: 3328; or (e-xxiv) three CDRs of a heavy chain variable region set forth as SEQ ID NO: 3329 and three CDRs of a light chain variable region set forth as SEQ ID NO: 3330; or (f-xxiv) three CDRs of a heavy chain variable region set forth as SEQ ID NO: 3331 and three CDRs of a light chain variable region set forth as SEQ ID NO: 3332; or (g-xxiv) three CDRs of a heavy chain variable region set forth as SEQ ID NO: 3333 and three CDRs of a light chain variable region set forth as SEQ ID NO: 3334; or (h-xxiv) three CDRs of a heavy chain variable region set forth as SEQ ID NO: 3335 and three CDRs of a light chain variable region set forth as SEQ ID NO: 3336; or (i-xxiv) three CDRs of a heavy chain variable region set forth as SEQ ID NO: 3337 and three CDRs of a light chain variable region set forth as SEQ ID NO: 3338; or (j-xxiv) three CDRs of a heavy chain variable region set forth as SEQ ID NO: 3339 and three CDRs of a light chain variable region set forth as SEQ ID NO: 3340; or (k-xxiv) three CDRs of a heavy chain variable region set forth as SEQ ID NO: 3341 and three CDRs of a light chain variable region set forth as SEQ ID NO: 3342; or (l-xxiv) three CDRs of a heavy chain variable region set forth as SEQ ID NO: 3343 and three CDRs of a light chain variable region set forth as SEQ ID NO: 3344; or (m-xxiv) three CDRs of a heavy chain variable region set forth as SEQ ID NO: 3345 and three CDRs of a light chain variable region set forth as SEQ ID NO: 3346; or (n-xxiv) three CDRs of a heavy chain variable region set forth as SEQ ID NO: 3347 and three CDRs of a light chain variable region set forth as SEQ ID NO: 3348; or (o-xxiv) three CDRs of a heavy chain variable region set forth as SEQ ID NO: 3349 and three CDRs of a light chain variable region set forth as SEQ ID NO: 3350; or (p-xxiv) three CDRs of a heavy chain variable region set forth as SEQ ID NO: 3351 and three CDRs of a light chain variable region set forth as SEQ ID NO: 3352; or (q-xxiv) three CDRs of a heavy chain variable region set forth as SEQ ID NO: 3353 and three CDRs of a light chain variable region set forth as SEQ ID NO: 3354; or (r-xxiv) three CDRs of a heavy chain variable region set forth as SEQ ID NO: 3355 and three CDRs of a light chain variable region set forth as SEQ ID NO: 3356; or (s-xxiv) three CDRs of a heavy chain variable region set forth as SEQ ID NO: 3357 and three CDRs of a light chain variable region set forth as SEQ ID NO: 3358; or (t-xxiv) three CDRs of a heavy chain variable region set forth as SEQ ID NO: 3359 and three CDRs of a light chain variable region set forth as SEQ ID NO: 3360; or (u-xxiv) three CDRs of a heavy chain variable region set forth as SEQ ID NO: 3361 and three CDRs of a light chain variable region set forth as SEQ ID NO: 3362; or (v-xxiv) three CDRs of a heavy chain variable region set forth as SEQ ID NO: 3363 and three CDRs of a light chain variable region set forth as SEQ ID NO: 3364; or (w-xxiv) three CDRs of a heavy chain variable region set forth as SEQ ID NO: 3365 and three CDRs of a light chain variable region set forth as SEQ ID NO: 3366; or (x-xxiv) three CDRs of a heavy chain variable region set forth as SEQ ID NO: 3367 and three CDRs of a light chain variable region set forth as SEQ ID NO: 3368; or (y-xxiv) three CDRs of a heavy chain variable region set forth as SEQ ID NO: 3369 and three CDRs of a light chain variable region set forth as SEQ ID NO: 3370; or (z-xxiv) three CDRs of a heavy chain variable region set forth as SEQ ID NO: 3371 and three CDRs of a light chain variable region set forth as SEQ ID NO: 3372; or (a-xxv) three CDRs of a heavy chain variable region set forth as SEQ ID NO: 3373 and three CDRs of a light chain variable region set forth as SEQ ID NO: 3374; or (b-xxv) three CDRs of a heavy chain variable region set forth as SEQ ID NO: 3375 and three CDRs of a light chain variable region set forth as SEQ ID NO: 3376; or (c-xxv) three CDRs of a heavy chain variable region set forth as SEQ ID NO: 3377 and three CDRs of a light chain variable region set forth as SEQ ID NO: 3378; or (d-xxv) three CDRs of a heavy chain variable region set forth as SEQ ID NO: 3379 and three CDRs of a light chain variable region set forth as SEQ ID NO: 3380; or (e-xxv) three CDRs of a heavy chain variable region set forth as SEQ ID NO: 3381 and three CDRs of a light chain variable region set forth as SEQ ID NO: 3382; or (f-xxv) three CDRs of a heavy chain variable region set forth as SEQ ID NO: 3383 and three CDRs of a light chain variable region set forth as SEQ ID NO: 3384; or (g-xxv) three CDRs of a heavy chain variable region set forth as SEQ ID NO: 3385 and three CDRs of a light chain variable region set forth as SEQ ID NO: 3386; or (h-xxv) three CDRs of a heavy chain variable region set forth as SEQ ID NO: 3387 and three CDRs of a light chain variable region set forth as SEQ ID NO: 3388; or (i-xxv) three CDRs of a heavy chain variable region set forth as SEQ ID NO: 3389 and three CDRs of a light chain variable region set forth as SEQ ID NO: 3390; or (j-xxv) three CDRs of a heavy chain variable region set forth as SEQ ID NO: 3391 and three CDRs of a light chain variable region set forth as SEQ ID NO: 3392; or (k-xxv) three CDRs of a heavy chain variable region set forth as SEQ ID NO: 3393 and three CDRs of a light chain variable region set forth as SEQ ID NO: 3394; or (l-xxv) three CDRs of a heavy chain variable region set forth as SEQ ID NO: 3395 and three CDRs of a light chain variable region set forth as SEQ ID NO: 3396; or (m-xxv) three CDRs of a heavy chain variable region set forth as SEQ ID NO: 3397 and three CDRs of a light chain variable region set forth as SEQ ID NO: 3398; or (n-xxv) three CDRs of a heavy chain variable region set forth as SEQ ID NO: 3399 and three CDRs of a light chain variable region set forth as SEQ ID NO: 3400; or (o-xxv) three CDRs of a heavy chain variable region set forth as SEQ ID NO: 3401 and three CDRs of a light chain variable region set forth as SEQ ID NO: 3402; or (p-xxv) three CDRs of a heavy chain variable region set forth as SEQ ID NO: 3403 and three CDRs of a light chain variable region set forth as SEQ ID NO: 3404; or (q-xxv) three CDRs of a heavy chain variable region set forth as SEQ ID NO: 3405 and three CDRs of a light chain variable region set forth as SEQ ID NO: 3406; or (r-xxv) three CDRs of a heavy chain variable region set forth as SEQ ID NO: 3407 and three CDRs of a light chain variable region set forth as SEQ ID NO: 3408; or (s-xxv) three CDRs of a heavy chain variable region set forth as SEQ ID NO: 3409 and three CDRs of a light chain variable region set forth as SEQ ID NO: 3410; or (t-xxv) three CDRs of a heavy chain variable region set forth as SEQ ID NO: 3411 and three CDRs of a light chain variable region set forth as SEQ ID NO: 3412; or (u-xxv) three CDRs of a heavy chain variable region set forth as SEQ ID NO: 3413 and three CDRs of a light chain variable region set forth as SEQ ID NO: 3414; or (v-xxv) three CDRs of a heavy chain variable region set forth as SEQ ID NO: 3415 and three CDRs of a light chain variable region set forth as SEQ ID NO: 3416; or (w-xxv) three CDRs of a heavy chain variable region set forth as SEQ ID NO: 3417 and three CDRs of a light chain variable region set forth as SEQ ID NO: 3418; or (x-xxv) three CDRs of a heavy chain variable region set forth as SEQ ID NO: 3419 and three CDRs of a light chain variable region set forth as SEQ ID NO: 3420; or (y-xxv) three CDRs of a heavy chain variable region set forth as SEQ ID NO: 3421 and three CDRs of a light chain variable region set forth as SEQ ID NO: 3422; or (z-xxv) three CDRs of a heavy chain variable region set forth as SEQ ID NO: 3423 and three CDRs of a light chain variable region set forth as SEQ ID NO: 3424; or (a-xxvi) three CDRs of a heavy chain variable region set forth as SEQ ID NO: 3425 and three CDRs of a light chain variable region set forth as SEQ ID NO: 3426; or (b-xxvi) three CDRs of a heavy chain variable region set forth as SEQ ID NO: 3427 and three CDRs of a light chain variable region set forth as SEQ ID NO: 3428; or (c-xxvi) three CDRs of a heavy chain variable region set forth as SEQ ID NO: 3429 and three CDRs of a light chain variable region set forth as SEQ ID NO: 3430; or (d-xxvi) three CDRs of a heavy chain variable region set forth as SEQ ID NO: 3431 and three CDRs of a light chain variable region set forth as SEQ ID NO: 3432; or (e-xxvi) three CDRs of a heavy chain variable region set forth as SEQ ID NO: 3433 and three CDRs of a light chain variable region set forth as SEQ ID NO: 3434; or (f-xxvi) three CDRs of a heavy chain variable region set forth as SEQ ID NO: 3435 and three CDRs of a light chain variable region set forth as SEQ ID NO: 3436; or (g-xxvi) three CDRs of a heavy chain variable region set forth as SEQ ID NO: 3437 and three CDRs of a light chain variable region set forth as SEQ ID NO: 3438; or (h-xxvi) three CDRs of a heavy chain variable region set forth as SEQ ID NO: 3439 and three CDRs of a light chain variable region set forth as SEQ ID NO: 3440; or (i-xxvi) three CDRs of a heavy chain variable region set forth as SEQ ID NO: 3441 and three CDRs of a light chain variable region set forth as SEQ ID NO: 3442; or (j-xxvi) three CDRs of a heavy chain variable region set forth as SEQ ID NO: 3443 and three CDRs of a light chain variable region set forth as SEQ ID NO: 3444; or (k-xxvi) three CDRs of a heavy chain variable region set forth as SEQ ID NO: 3445 and three CDRs of a light chain variable region set forth as SEQ ID NO: 3446; or (l-xxvi) three CDRs of a heavy chain variable region set forth as SEQ ID NO: 3447 and three CDRs of a light chain variable region set forth as SEQ ID NO: 3448; or (m-xxvi) three CDRs of a heavy chain variable region set forth as SEQ ID NO: 3449 and three CDRs of a light chain variable region set forth as SEQ ID NO: 3450; or (n-xxvi) three CDRs of a heavy chain variable region set forth as SEQ ID NO: 3451 and three CDRs of a light chain variable region set forth as SEQ ID NO: 3452; or (o-xxvi) three CDRs of a heavy chain variable region set forth as SEQ ID NO: 3453 and three CDRs of a light chain variable region set forth as SEQ ID NO: 3454; or (p-xxvi) three CDRs of a heavy chain variable region set forth as SEQ ID NO: 3455 and three CDRs of a light chain variable region set forth as SEQ ID NO: 3456; or (q-xxvi) three CDRs of a heavy chain variable region set forth as SEQ ID NO: 3457 and three CDRs of a light chain variable region set forth as SEQ ID NO: 3458; or (r-xxvi) three CDRs of a heavy chain variable region set forth as SEQ ID NO: 3459 and three CDRs of a light chain variable region set forth as SEQ ID NO: 3460; or (s-xxvi) three CDRs of a heavy chain variable region set forth as SEQ ID NO: 3461 and three CDRs of a light chain variable region set forth as SEQ ID NO: 3462; or (t-xxvi) three CDRs of a heavy chain variable region set forth as SEQ ID NO: 3463 and three CDRs of a light chain variable region set forth as SEQ ID NO: 3464; or (u-xxvi) three CDRs of a heavy chain variable region set forth as SEQ ID NO: 3465 and three CDRs of a light chain variable region set forth as SEQ ID NO: 3466; or (v-xxvi) three CDRs of a heavy chain variable region set forth as SEQ ID NO: 3467 and three CDRs of a light chain variable region set forth as SEQ ID NO: 3468; or (w-xxvi) three CDRs of a heavy chain variable region set forth as SEQ ID NO: 3469 and three CDRs of a light chain variable region set forth as SEQ ID NO: 3470; or (x-xxvi) three CDRs of a heavy chain variable region set forth as SEQ ID NO: 3471 and three CDRs of a light chain variable region set forth as SEQ ID NO: 3472; or (y-xxvi) three CDRs of a heavy chain variable region set forth as SEQ ID NO: 3473 and three CDRs of a light chain variable region set forth as SEQ ID NO: 3474; or (z-xxvi) three CDRs of a heavy chain variable region set forth as SEQ ID NO: 3475 and three CDRs of a light chain variable region set forth as SEQ ID NO: 3476; or (a-xxvii) three CDRs of a heavy chain variable region set forth as SEQ ID NO: 3477 and three CDRs of a light chain variable region set forth as SEQ ID NO: 3478; or (b-xxvii) three CDRs of a heavy chain variable region set forth as SEQ ID NO: 3479 and three CDRs of a light chain variable region set forth as SEQ ID NO: 3480; or (c-xxvii) three CDRs of a heavy chain variable region set forth as SEQ ID NO: 3481 and three CDRs of a light chain variable region set forth as SEQ ID NO: 3482; or (d-xxvii) three CDRs of a heavy chain variable region set forth as SEQ ID NO: 3483 and three CDRs of a light chain variable region set forth as SEQ ID NO: 3484; or (e-xxvii) three CDRs of a heavy chain variable region set forth as SEQ ID NO: 3485 and three CDRs of a light chain variable region set forth as SEQ ID NO: 3486; or (f-xxvii) three CDRs of a heavy chain variable region set forth as SEQ ID NO: 3487 and three CDRs of a light chain variable region set forth as SEQ ID NO: 3488; or (g-xxvii) three CDRs of a heavy chain variable region set forth as SEQ ID NO: 3489 and three CDRs of a light chain variable region set forth as SEQ ID NO: 3490; or (h-xxvii) three CDRs of a heavy chain variable region set forth as SEQ ID NO: 3491 and three CDRs of a light chain variable region set forth as SEQ ID NO: 3492; or (i-xxvii) three CDRs of a heavy chain variable region set forth as SEQ ID NO: 3493 and three CDRs of a light chain variable region set forth as SEQ ID NO: 3494; or (j-xxvii) three CDRs of a heavy chain variable region set forth as SEQ ID NO: 3495 and three CDRs of a light chain variable region set forth as SEQ ID NO: 3496; or (k-xxvii) three CDRs of a heavy chain variable region set forth as SEQ ID NO: 3497 and three CDRs of a light chain variable region set forth as SEQ ID NO: 3498; or (l-xxvii) three CDRs of a heavy chain variable region set forth as SEQ ID NO: 3499 and three CDRs of a light chain variable region set forth as SEQ ID NO: 3500; or (m-xxvii) three CDRs of a heavy chain variable region set forth as SEQ ID NO: 3501 and three CDRs of a light chain variable region set forth as SEQ ID NO: 3502; or (n-xxvii) three CDRs of a heavy chain variable region set forth as SEQ ID NO: 3503 and three CDRs of a light chain variable region set forth as SEQ ID NO: 3504; or (o-xxvii) three CDRs of a heavy chain variable region set forth as SEQ ID NO: 3505 and three CDRs of a light chain variable region set forth as SEQ ID NO: 3506; or (p-xxvii) three CDRs of a heavy chain variable region set forth as SEQ ID NO: 3507 and three CDRs of a light chain variable region set forth as SEQ ID NO: 3508; or (q-xxvii) three CDRs of a heavy chain variable region set forth as SEQ ID NO: 3509 and three CDRs of a light chain variable region set forth as SEQ ID NO: 3510; or (r-xxvii) three CDRs of a heavy chain variable region set forth as SEQ ID NO: 3511 and three CDRs of a light chain variable region set forth as SEQ ID NO: 3512; or (s-xxvii) three CDRs of a heavy chain variable region set forth as SEQ ID NO: 3513 and three CDRs of a light chain variable region set forth as SEQ ID NO: 3514; or (t-xxvii) three CDRs of a heavy chain variable region set forth as SEQ ID NO: 3515 and three CDRs of a light chain variable region set forth as SEQ ID NO: 3516; or (u-xxvii) three CDRs of a heavy chain variable region set forth as SEQ ID NO: 3517 and three CDRs of a light chain variable region set forth as SEQ ID NO: 3518; or (v-xxvii) three CDRs of a heavy chain variable region set forth as SEQ ID NO: 3519 and three CDRs of a light chain variable region set forth as SEQ ID NO: 3520; or (w-xxvii) three CDRs of a heavy chain variable region set forth as SEQ ID NO: 3521 and three CDRs of a light chain variable region set forth as SEQ ID NO: 3522; or (x-xxvii) three CDRs of a heavy chain variable region set forth as SEQ ID NO: 3523 and three CDRs of a light chain variable region set forth as SEQ ID NO: 3524; or (y-xxvii) three CDRs of a heavy chain variable region set forth as SEQ ID NO: 3525 and three CDRs of a light chain variable region set forth as SEQ ID NO: 3526; or (z-xxvii) three CDRs of a heavy chain variable region set forth as SEQ ID NO: 3527 and three CDRs of a light chain variable region set forth as SEQ ID NO: 3528; or (a-xxviii) three CDRs of a heavy chain variable region set forth as SEQ ID NO: 3529 and three CDRs of a light chain variable region set forth as SEQ ID NO: 3530; or (b-xxviii) three CDRs of a heavy chain variable region set forth as SEQ ID NO: 3531 and three CDRs of a light chain variable region set forth as SEQ ID NO: 3532; or (c-xxviii) three CDRs of a heavy chain variable region set forth as SEQ ID NO: 3533 and three CDRs of a light chain variable region set forth as SEQ ID NO: 3534; or (d-xxviii) three CDRs of a heavy chain variable region set forth as SEQ ID NO: 3535 and three CDRs of a light chain variable region set forth as SEQ ID NO: 3536; or (e-xxviii) three CDRs of a heavy chain variable region set forth as SEQ ID NO: 3537 and three CDRs of a light chain variable region set forth as SEQ ID NO: 3538; or (f-xxviii) three CDRs of a heavy chain variable region set forth as SEQ ID NO: 3539 and three CDRs of a light chain variable region set forth as SEQ ID NO: 3540; or (g-xxviii) three CDRs of a heavy chain variable region set forth as SEQ ID NO: 3541 and three CDRs of a light chain variable region set forth as SEQ ID NO: 3542; or (h-xxviii) three CDRs of a heavy chain variable region set forth as SEQ ID NO: 3543 and three CDRs of a light chain variable region set forth as SEQ ID NO: 3544; or (i-xxviii) three CDRs of a heavy chain variable region set forth as SEQ ID NO: 3545 and three CDRs of a light chain variable region set forth as SEQ ID NO: 3546; or (j-xxviii) three CDRs of a heavy chain variable region set forth as SEQ ID NO: 3547 and three CDRs of a light chain variable region set forth as SEQ ID NO: 3548; or (k-xxviii) three CDRs of a heavy chain variable region set forth as SEQ ID NO: 3549 and three CDRs of a light chain variable region set forth as SEQ ID NO: 3550; or (l-xxviii) three CDRs of a heavy chain variable region set forth as SEQ ID NO: 3551 and three CDRs of a light chain variable region set forth as SEQ ID NO: 3552; or (m-xxviii) three CDRs of a heavy chain variable region set forth as SEQ ID NO: 3553 and three CDRs of a light chain variable region set forth as SEQ ID NO: 3554; or (n-xxviii) three CDRs of a heavy chain variable region set forth as SEQ ID NO: 3555 and three CDRs of a light chain variable region set forth as SEQ ID NO: 3556; or (o-xxviii) three CDRs of a heavy chain variable region set forth as SEQ ID NO: 3557 and three CDRs of a light chain variable region set forth as SEQ ID NO: 3558; or (p-xxviii) three CDRs of a heavy chain variable region set forth as SEQ ID NO: 3559 and three CDRs of a light chain variable region set forth as SEQ ID NO: 3560; or (q-xxviii) three CDRs of a heavy chain variable region set forth as SEQ ID NO: 3561 and three CDRs of a light chain variable region set forth as SEQ ID NO: 3562; or (r-xxviii) three CDRs of a heavy chain variable region set forth as SEQ ID NO: 3563 and three CDRs of a light chain variable region set forth as SEQ ID NO: 3564; or (s-xxviii) three CDRs of a heavy chain variable region set forth as SEQ ID NO: 3565 and three CDRs of a light chain variable region set forth as SEQ ID NO: 3566; or (t-xxviii) three CDRs of a heavy chain variable region set forth as SEQ ID NO: 3567 and three CDRs of a light chain variable region set forth as SEQ ID NO: 3568; or (u-xxviii) three CDRs of a heavy chain variable region set forth as SEQ ID NO: 3569 and three CDRs of a light chain variable region set forth as SEQ ID NO: 3570; or (v-xxviii)) three CDRs of a heavy chain variable region set forth as SEQ ID NO: 3571 and three CDRs of a light chain variable region set forth as SEQ ID NO: 3572; or (w-xxviii) three CDRs of a heavy chain variable region set forth as SEQ ID NO: 3573 and three CDRs of a light chain variable region set forth as SEQ ID NO: 3574; or (x-xxviii) three CDRs of a heavy chain variable region set forth as SEQ ID NO: 3575 and three CDRs of a light chain variable region set forth as SEQ ID NO: 3576; or (y-xxviii) three CDRs of a heavy chain variable region set forth as SEQ ID NO: 3577 and three CDRs of a light chain variable region set forth as SEQ ID NO: 3578; or (z-xxviii) three CDRs of a heavy chain variable region set forth as SEQ ID NO: 3579 and three CDRs of a light chain variable region set forth as SEQ ID NO: 3580; or (a-xxix) three CDRs of a heavy chain variable region set forth as SEQ ID NO: 3581 and three CDRs of a light chain variable region set forth as SEQ ID NO: 3582; or (b-xxix) three CDRs of a heavy chain variable region set forth as SEQ ID NO: 3583 and three CDRs of a light chain variable region set forth as SEQ ID NO: 3584; or (c-xxix) three CDRs of a heavy chain variable region set forth as SEQ ID NO: 3585 and three CDRs of a light chain variable region set forth as SEQ ID NO: 3586; or (d-xxix) three CDRs of a heavy chain variable region set forth as SEQ ID NO: 3587 and three CDRs of a light chain variable region set forth as SEQ ID NO: 3588; or (e-xxix) three CDRs of a heavy chain variable region set forth as SEQ ID NO: 3589 and three CDRs of a light chain variable region set forth as SEQ ID NO: 3590; or (f-xxix) three CDRs of a heavy chain variable region set forth as SEQ ID NO: 3591 and three CDRs of a light chain variable region set forth as SEQ ID NO: 3592; or (g-xxix) three CDRs of a heavy chain variable region set forth as SEQ ID NO: 3593 and three CDRs of a light chain variable region set forth as SEQ ID NO: 3594; or (h-xxix) three CDRs of a heavy chain variable region set forth as SEQ ID NO: 3595 and three CDRs of a light chain variable region set forth as SEQ ID NO: 3596; or (i-xxix) three CDRs of a heavy chain variable region set forth as SEQ ID NO: 3597 and three CDRs of a light chain variable region set forth as SEQ ID NO: 3598; or (j-xxix) three CDRs of a heavy chain variable region set forth as SEQ ID NO: 3599 and three CDRs of a light chain variable region set forth as SEQ ID NO: 3600; or (k-xxix) three CDRs of a heavy chain variable region set forth as SEQ ID NO: 3601 and three CDRs of a light chain variable region set forth as SEQ ID NO: 3602; or (l-xxix) three CDRs of a heavy chain variable region set forth as SEQ ID NO: 3603 and three CDRs of a light chain variable region set forth as SEQ ID NO: 3604; or (m-xxix) three CDRs of a heavy chain variable region set forth as SEQ ID NO: 3605 and three CDRs of a light chain variable region set forth as SEQ ID NO: 3606; or (n-xxix) three CDRs of a heavy chain variable region set forth as SEQ ID NO: 3607 and three CDRs of a light chain variable region set forth as SEQ ID NO: 3608; or (o-xxix) three CDRs of a heavy chain variable region set forth as SEQ ID NO: 3609 and three CDRs of a light chain variable region set forth as SEQ ID NO: 3610; or (p-xxix) three CDRs of a heavy chain variable region set forth as SEQ ID NO: 3611 and three CDRs of a light chain variable region set forth as SEQ ID NO: 3612; or (q-xxix) three CDRs of a heavy chain variable region set forth as SEQ ID NO: 3613 and three CDRs of a light chain variable region set forth as SEQ ID NO: 3614; or (r-xxix) three CDRs of a heavy chain variable region set forth as SEQ ID NO: 3615 and three CDRs of a light chain variable region set forth as SEQ ID NO: 3616; or (s-xxix) three CDRs of a heavy chain variable region set forth as SEQ ID NO: 3617 and three CDRs of a light chain variable region set forth as SEQ ID NO: 3618; or (t-xxix) three CDRs of a heavy chain variable region set forth as SEQ ID NO: 3619 and three CDRs of a light chain variable region set forth as SEQ ID NO: 3620; or (u-xxix) three CDRs of a heavy chain variable region set forth as SEQ ID NO: 3621 and three CDRs of a light chain variable region set forth as SEQ ID NO: 3622; or (v-xxix) three CDRs of a heavy chain variable region set forth as SEQ ID NO: 3623 and three CDRs of a light chain variable region set forth as SEQ ID NO: 3624; or (w-xxix) three CDRs of a heavy chain variable region set forth as SEQ ID NO: 3625 and three CDRs of a light chain variable region set forth as SEQ ID NO: 3626; or (x-xxix) three CDRs of a heavy chain variable region set forth as SEQ ID NO: 3627 and three CDRs of a light chain variable region set forth as SEQ ID NO: 3628; or (y-xxix) three CDRs of a heavy chain variable region set forth as SEQ ID NO: 3629 and three CDRs of a light chain variable region set forth as SEQ ID NO: 3630; or (z-xxix) three CDRs of a heavy chain variable region set forth as SEQ ID NO: 3631 and three CDRs of a light chain variable region set forth as SEQ ID NO: 3632; or (a-xxx) three CDRs of a heavy chain variable region set forth as SEQ ID NO: 3633 and three CDRs of a light chain variable region set forth as SEQ ID NO: 3634; or (b-xxx) three CDRs of a heavy chain variable region set forth as SEQ ID NO: 3635 and three CDRs of a light chain variable region set forth as SEQ ID NO: 3636; or (c-xxx) three CDRs of a heavy chain variable region set forth as SEQ ID NO: 3637 and three CDRs of a light chain variable region set forth as SEQ ID NO: 3638; or (d-xxx) three CDRs of a heavy chain variable region set forth as SEQ ID NO: 3639 and three CDRs of a light chain variable region set forth as SEQ ID NO: 3640; or (e-xxx) three CDRs of a heavy chain variable region set forth as SEQ ID NO: 3641 and three CDRs of a light chain variable region set forth as SEQ ID NO: 3642; or (f-xxx) three CDRs of a heavy chain variable region set forth as SEQ ID NO: 3643 and three CDRs of a light chain variable region set forth as SEQ ID NO: 3644; or (g-xxx) three CDRs of a heavy chain variable region set forth as SEQ ID NO: 3645 and three CDRs of a light chain variable region set forth as SEQ ID NO: 3646; or (h-xxx) three CDRs of a heavy chain variable region set forth as SEQ ID NO: 3647 and three CDRs of a light chain variable region set forth as SEQ ID NO: 3648; or (i-xxx) three CDRs of a heavy chain variable region set forth as SEQ ID NO: 3649 and three CDRs of a light chain variable region set forth as SEQ ID NO: 3650; or (j-xxx) three CDRs of a heavy chain variable region set forth as SEQ ID NO: 3651 and three CDRs of a light chain variable region set forth as SEQ ID NO: 3652; or (k-xxx) three CDRs of a heavy chain variable region set forth as SEQ ID NO: 3653 and three CDRs of a light chain variable region set forth as SEQ ID NO: 3654; or (l-xxx) three CDRs of a heavy chain variable region set forth as SEQ ID NO: 3655 and three CDRs of a light chain variable region set forth as SEQ ID NO: 3656; or (m-xxx) three CDRs of a heavy chain variable region set forth as SEQ ID NO: 3657 and three CDRs of a light chain variable region set forth as SEQ ID NO: 3658; or (n-xxx) three CDRs of a heavy chain variable region set forth as SEQ ID NO: 3659 and three CDRs of a light chain variable region set forth as SEQ ID NO: 3660; or (o-xxx) three CDRs of a heavy chain variable region set forth as SEQ ID NO: 3661 and three CDRs of a light chain variable region set forth as SEQ ID NO: 3662; or (p-xxx) three CDRs of a heavy chain variable region set forth as SEQ ID NO: 3663 and three CDRs of a light chain variable region set forth as SEQ ID NO: 3664; or (q-xxx) three CDRs of a heavy chain variable region set forth as SEQ ID NO: 3665 and three CDRs of a light chain variable region set forth as SEQ ID NO: 3666; or (r-xxx) three CDRs of a heavy chain variable region set forth as SEQ ID NO: 3667 and three CDRs of a light chain variable region set forth as SEQ ID NO: 3668; or (s-xxx) three CDRs of a heavy chain variable region set forth as SEQ ID NO: 3669 and three CDRs of a light chain variable region set forth as SEQ ID NO: 3670; or (t-xxx) three CDRs of a heavy chain variable region set forth as SEQ ID NO: 3671 and three CDRs of a light chain variable region set forth as SEQ ID NO: 3672; or (u-xxx) three CDRs of a heavy chain variable region set forth as SEQ ID NO: 3673 and three CDRs of a light chain variable region set forth as SEQ ID NO: 3674; or (v-xxx) three CDRs of a heavy chain variable region set forth as SEQ ID NO: 3675 and three CDRs of a light chain variable region set forth as SEQ ID NO: 3676; or (w-xxx) three CDRs of a heavy chain variable region set forth as SEQ ID NO: 3677 and three CDRs of a light chain variable region set forth as SEQ ID NO: 3678; or (x-xxx) three CDRs of a heavy chain variable region set forth as SEQ ID NO: 3679 and three CDRs of a light chain variable region set forth as SEQ ID NO: 3680; or (y-xxx) three CDRs of a heavy chain variable region set forth as SEQ ID NO: 3681 and three CDRs of a light chain variable region set forth as SEQ ID NO: 3682; or (z-xxx) three CDRs of a heavy chain variable region set forth as SEQ ID NO: 3683 and three CDRs of a light chain variable region set forth as SEQ ID NO: 3684; or (a-xxxi) three CDRs of a heavy chain variable region set forth as SEQ ID NO: 3685 and three CDRs of a light chain variable region set forth as SEQ ID NO: 3686; or (b-xxxi) three CDRs of a heavy chain variable region set forth as SEQ ID NO: 3687 and three CDRs of a light chain variable region set forth as SEQ ID NO: 3688; or (c-xxxi) three CDRs of a heavy chain variable region set forth as SEQ ID NO: 3689 and three CDRs of a light chain variable region set forth as SEQ ID NO: 3690; or (d-xxxi) three CDRs of a heavy chain variable region set forth as SEQ ID NO: 3691 and three CDRs of a light chain variable region set forth as SEQ ID NO: 3692; or (e-xxxi) three CDRs of a heavy chain variable region set forth as SEQ ID NO: 3693 and three CDRs of a light chain variable region set forth as SEQ ID NO: 3694; or (f-xxxi) three CDRs of a heavy chain variable region set forth as SEQ ID NO: 3695 and three CDRs of a light chain variable region set forth as SEQ ID NO: 3696; or (g-xxxi) three CDRs of a heavy chain variable region set forth as SEQ ID NO: 3697 and three CDRs of a light chain variable region set forth as SEQ ID NO: 3698; or (h-xxxi) three CDRs of a heavy chain variable region set forth as SEQ ID NO: 3699 and three CDRs of a light chain variable region set forth as SEQ ID NO: 3700; or (i-xxxi) three CDRs of a heavy chain variable region set forth as SEQ ID NO: 3701 and three CDRs of a light chain variable region set forth as SEQ ID NO: 3702; or (j-xxxi) three CDRs of a heavy chain variable region set forth as SEQ ID NO: 3703 and three CDRs of a light chain variable region set forth as SEQ ID NO: 3704; or (k-xxxi) three CDRs of a heavy chain variable region set forth as SEQ ID NO: 3705 and three CDRs of a light chain variable region set forth as SEQ ID NO: 3706; or (l-xxxi) three CDRs of a heavy chain variable region set forth as SEQ ID NO: 3707 and three CDRs of a light chain variable region set forth as SEQ ID NO: 3708; or (m-xxxi) three CDRs of a heavy chain variable region set forth as SEQ ID NO: 3709 and three CDRs of a light chain variable region set forth as SEQ ID NO: 3710; or (n-xxxi) three CDRs of a heavy chain variable region set forth as SEQ ID NO: 3711 and three CDRs of a light chain variable region set forth as SEQ ID NO: 3712; or (o-xxxi) three CDRs of a heavy chain variable region set forth as SEQ ID NO: 3713 and three CDRs of a light chain variable region set forth as SEQ ID NO: 3714; or (p-xxxi) three CDRs of a heavy chain variable region set forth as SEQ ID NO: 3715 and three CDRs of a light chain variable region set forth as SEQ ID NO: 3716; or (q-xxxi) three CDRs of a heavy chain variable region set forth as SEQ ID NO: 3717 and three CDRs of a light chain variable region set forth as SEQ ID NO: 3718; or (r-xxxi) three CDRs of a heavy chain variable region set forth as SEQ ID NO: 3719 and three CDRs of a light chain variable region set forth as SEQ ID NO: 3720; or (s-xxxi) three CDRs of a heavy chain variable region set forth as SEQ ID NO: 3721 and three CDRs of a light chain variable region set forth as SEQ ID NO: 3722; or (t-xxxi) three CDRs of a heavy chain variable region set forth as SEQ ID NO: 3723 and three CDRs of a light chain variable region set forth as SEQ ID NO: 3724; or (u-xxxi) three CDRs of a heavy chain variable region set forth as SEQ ID NO: 3725 and three CDRs of a light chain variable region set forth as SEQ ID NO: 3726; or (v-xxxi) three CDRs of a heavy chain variable region set forth as SEQ ID NO: 3727 and three CDRs of a light chain variable region set forth as SEQ ID NO: 3728; or (w-xxxi) three CDRs of a heavy chain variable region set forth as SEQ ID NO: 3729 and three CDRs of a light chain variable region set forth as SEQ ID NO: 3730; or (x-xxxi) three CDRs of a heavy chain variable region set forth as SEQ ID NO: 3731 and three CDRs of a light chain variable region set forth as SEQ ID NO: 3732; or (y-xxxi) three CDRs of a heavy chain variable region set forth as SEQ ID NO: 3733 and three CDRs of a light chain variable region set forth as SEQ ID NO: 3734; or (z-xxxi) three CDRs of a heavy chain variable region set forth as SEQ ID NO: 3735 and three CDRs of a light chain variable region set forth as SEQ ID NO: 3736; or (a-xxxii) three CDRs of a heavy chain variable region set forth as SEQ ID NO: 3737 and three CDRs of a light chain variable region set forth as SEQ ID NO: 3738; or (b-xxxii) three CDRs of a heavy chain variable region set forth as SEQ ID NO: 3739 and three CDRs of a light chain variable region set forth as SEQ ID NO: 3740; or (c-xxxii) three CDRs of a heavy chain variable region set forth as SEQ ID NO: 3741 and three CDRs of a light chain variable region set forth as SEQ ID NO: 3742; or (d-xxxii) three CDRs of a heavy chain variable region set forth as SEQ ID NO: 3743 and three CDRs of a light chain variable region set forth as SEQ ID NO: 3744; or (e-xxxii) three CDRs of a heavy chain variable region set forth as SEQ ID NO: 3745 and three CDRs of a light chain variable region set forth as SEQ ID NO: 3746; or (f-xxxii) three CDRs of a heavy chain variable region set forth as SEQ ID NO: 3747 and three CDRs of a light chain variable region set forth as SEQ ID NO: 3748; or (g-xxxii) three CDRs of a heavy chain variable region set forth as SEQ ID NO: 3749 and three CDRs of a light chain variable region set forth as SEQ ID NO: 3750; or (h-xxxii) three CDRs of a heavy chain variable region set forth as SEQ ID NO: 3751 and three CDRs of a light chain variable region set forth as SEQ ID NO: 3752; or (i-xxxii) three CDRs of a heavy chain variable region set forth as SEQ ID NO: 3753 and three CDRs of a light chain variable region set forth as SEQ ID NO: 3754; or (j-xxxii) three CDRs of a heavy chain variable region set forth as SEQ ID NO: 3755 and three CDRs of a light chain variable region set forth as SEQ ID NO: 3756; or (k-xxxii) three CDRs of a heavy chain variable region set forth as SEQ ID NO: 3757 and three CDRs of a light chain variable region set forth as SEQ ID NO: 3758; or (l-xxxii) three CDRs of a heavy chain variable region set forth as SEQ ID NO: 3759 and three CDRs of a light chain variable region set forth as SEQ ID NO: 3760; or (m-xxxii) three CDRs of a heavy chain variable region set forth as SEQ ID NO: 3761 and three CDRs of a light chain variable region set forth as SEQ ID NO: 3762; or (n-xxxii) three CDRs of a heavy chain variable region set forth as SEQ ID NO: 3763 and three CDRs of a light chain variable region set forth as SEQ ID NO: 3764; or (o-xxxii) three CDRs of a heavy chain variable region set forth as SEQ ID NO: 3765 and three CDRs of a light chain variable region set forth as SEQ ID NO: 3766; or (p-xxxii) three CDRs of a heavy chain variable region set forth as SEQ ID NO: 3767 and three CDRs of a light chain variable region set forth as SEQ ID NO: 3768; or (q-xxxii) three CDRs of a heavy chain variable region set forth as SEQ ID NO: 3769 and three CDRs of a light chain variable region set forth as SEQ ID NO: 3770; or (r-xxxii) three CDRs of a heavy chain variable region set forth as SEQ ID NO: 3771 and three CDRs of a light chain variable region set forth as SEQ ID NO: 3772; or (s-xxxii) three CDRs of a heavy chain variable region set forth as SEQ ID NO: 3773 and three CDRs of a light chain variable region set forth as SEQ ID NO: 3774; or (t-xxxii) three CDRs of a heavy chain variable region set forth as SEQ ID NO: 3775 and three CDRs of a light chain variable region set forth as SEQ ID NO: 3776; or (u-xxxii) three CDRs of a heavy chain variable region set forth as SEQ ID NO: 3777 and three CDRs of a light chain variable region set forth as SEQ ID NO: 3778; or (v-xxxii) three CDRs of a heavy chain variable region set forth as SEQ ID NO: 3779 and three CDRs of a light chain variable region set forth as SEQ ID NO: 3780; or (w-xxxii) three CDRs of a heavy chain variable region set forth as SEQ ID NO: 3781 and three CDRs of a light chain variable region set forth as SEQ ID NO: 3782; or (x-xxxii) three CDRs of a heavy chain variable region set forth as SEQ ID NO: 3783 and three CDRs of a light chain variable region set forth as SEQ ID NO: 3784; or (y-xxxii) three CDRs of a heavy chain variable region set forth as SEQ ID NO: 3785 and three CDRs of a light chain variable region set forth as SEQ ID NO: 3786; or (z-xxxii) three CDRs of a heavy chain variable region set forth as SEQ ID NO: 3787 and three CDRs of a light chain variable region set forth as SEQ ID NO: 3788; or (a-xxxiii) three CDRs of a heavy chain variable region set forth as SEQ ID NO: 3789 and three CDRs of a light chain variable region set forth as SEQ ID NO: 3790; or (b-xxxiii) three CDRs of a heavy chain variable region set forth as SEQ ID NO: 3791 and three CDRs of a light chain variable region set forth as SEQ ID NO: 3792; or (c-xxxiii) three CDRs of a heavy chain variable region set forth as SEQ ID NO: 3793 and three CDRs of a light chain variable region set forth as SEQ ID NO: 3794; or (d-xxxiii) three CDRs of a heavy chain variable region set forth as SEQ ID NO: 3795 and three CDRs of a light chain variable region set forth as SEQ ID NO: 3796; or (e-xxxiii) three CDRs of a heavy chain variable region set forth as SEQ ID NO: 3797 and three CDRs of a light chain variable region set forth as SEQ ID NO: 3798; or (f-xxxiii) three CDRs of a heavy chain variable region set forth as SEQ ID NO: 3799 and three CDRs of a light chain variable region set forth as SEQ ID NO: 3800; or (g-xxxiii) three CDRs of a heavy chain variable region set forth as SEQ ID NO: 3801 and three CDRs of a light chain variable region set forth as SEQ ID NO: 3802; or (h-xxxiii) three CDRs of a heavy chain variable region set forth as SEQ ID NO: 3803 and three CDRs of a light chain variable region set forth as SEQ ID NO: 3804; or (i-xxxiii) three CDRs of a heavy chain variable region set forth as SEQ ID NO: 3805 and three CDRs of a light chain variable region set forth as SEQ ID NO: 3806; or (j-xxxiii) three CDRs of a heavy chain variable region set forth as SEQ ID NO: 3807 and three CDRs of a light chain variable region set forth as SEQ ID NO: 3808; or (k-xxxiii) three CDRs of a heavy chain variable region set forth as SEQ ID NO: 3809 and three CDRs of a light chain variable region set forth as SEQ ID NO: 3810; or (l-xxxiii) three CDRs of a heavy chain variable region set forth as SEQ ID NO: 3811 and three CDRs of a light chain variable region set forth as SEQ ID NO: 3812; or (m-xxxiii) three CDRs of a heavy chain variable region set forth as SEQ ID NO: 3813 and three CDRs of a light chain variable region set forth as SEQ ID NO: 3814; or (n-xxxiii) three CDRs of a heavy chain variable region set forth as SEQ ID NO: 3815 and three CDRs of a light chain variable region set forth as SEQ ID NO: 3816; or (o-xxxiii) three CDRs of a heavy chain variable region set forth as SEQ ID NO: 3817 and three CDRs of a light chain variable region set forth as SEQ ID NO: 3818; or (p-xxxiii) three CDRs of a heavy chain variable region set forth as SEQ ID NO: 3819 and three CDRs of a light chain variable region set forth as SEQ ID NO: 3820; or (q-xxxiii) three CDRs of a heavy chain variable region set forth as SEQ ID NO: 3821 and three CDRs of a light chain variable region set forth as SEQ ID NO: 3822; or (r-xxxiii) three CDRs of a heavy chain variable region set forth as SEQ ID NO: 3823 and three CDRs of a light chain variable region set forth as SEQ ID NO: 3824; or (s-xxxiii) three CDRs of a heavy chain variable region set forth as SEQ ID NO: 3825 and three CDRs of a light chain variable region set forth as SEQ ID NO: 3826; or (t-xxxiii) three CDRs of a heavy chain variable region set forth as SEQ ID NO: 3827 and three CDRs of a light chain variable region set forth as SEQ ID NO: 3828; or (u-xxxiii) three CDRs of a heavy chain variable region set forth as SEQ ID NO: 3829 and three CDRs of a light chain variable region set forth as SEQ ID NO: 3830; or (v-xxxiii) three CDRs of a heavy chain variable region set forth as SEQ ID NO: 3831 and three CDRs of a light chain variable region set forth as SEQ ID NO: 3832; or (w-xxxiii) three CDRs of a heavy chain variable region set forth as SEQ ID NO: 3833 and three CDRs of a light chain variable region set forth as SEQ ID NO: 3834; or (x-xxxiii) three CDRs of a heavy chain variable region set forth as SEQ ID NO: 3835 and three CDRs of a light chain variable region set forth as SEQ ID NO: 3836; or (y-xxxiii) three CDRs of a heavy chain variable region set forth as SEQ ID NO: 3837 and three CDRs of a light chain variable region set forth as SEQ ID NO: 3838; or (z-xxxiii) three CDRs of a heavy chain variable region set forth as SEQ ID NO: 3839 and three CDRs of a light chain variable region set forth as SEQ ID NO: 3840; or (a-xxxiv) three CDRs of a heavy chain variable region set forth as SEQ ID NO: 3841 and three CDRs of a light chain variable region set forth as SEQ ID NO: 3842; or (b-xxxiv) three CDRs of a heavy chain variable region set forth as SEQ ID NO: 3843 and three CDRs of a light chain variable region set forth as SEQ ID NO: 3844; or (c-xxxiv) three CDRs of a heavy chain variable region set forth as SEQ ID NO: 3845 and three CDRs of a light chain variable region set forth as SEQ ID NO: 3846; or (d-xxxiv) three CDRs of a heavy chain variable region set forth as SEQ ID NO: 3847 and three CDRs of a light chain variable region set forth as SEQ ID NO: 3848; or (e-xxxiv) three CDRs of a heavy chain variable region set forth as SEQ ID NO: 3849 and three CDRs of a light chain variable region set forth as SEQ ID NO: 3850; or (f-xxxiv) three CDRs of a heavy chain variable region set forth as SEQ ID NO: 3851 and three CDRs of a light chain variable region set forth as SEQ ID NO: 3852; or (g-xxxiv) three CDRs of a heavy chain variable region set forth as SEQ ID NO: 3853 and three CDRs of a light chain variable region set forth as SEQ ID NO: 3854; or (h-xxxiv) three CDRs of a heavy chain variable region set forth as SEQ ID NO: 3855 and three CDRs of a light chain variable region set forth as SEQ ID NO: 3856; or (i-xxxiv) three CDRs of a heavy chain variable region set forth as SEQ ID NO: 3857 and three CDRs of a light chain variable region set forth as SEQ ID NO: 3858; or (j-xxxiv) three CDRs of a heavy chain variable region set forth as SEQ ID NO: 3859 and three CDRs of a light chain variable region set forth as SEQ ID NO: 3860; or (k-xxxiv) three CDRs of a heavy chain variable region set forth as SEQ ID NO: 3861 and three CDRs of a light chain variable region set forth as SEQ ID NO: 3862; or (l-xxxiv) three CDRs of a heavy chain variable region set forth as SEQ ID NO: 3863 and three CDRs of a light chain variable region set forth as SEQ ID NO: 3864; or (m-xxxiv) three CDRs of a heavy chain variable region set forth as SEQ ID NO: 3865 and three CDRs of a light chain variable region set forth as SEQ ID NO: 3866; or (n-xxxiv) three CDRs of a heavy chain variable region set forth as SEQ ID NO: 3867 and three CDRs of a light chain variable region set forth as SEQ ID NO: 3868; or (o-xxxiv) three CDRs of a heavy chain variable region set forth as SEQ ID NO: 3869 and three CDRs of a light chain variable region set forth as SEQ ID NO: 3870; or (p-xxxiv) three CDRs of a heavy chain variable region set forth as SEQ ID NO: 3871 and three CDRs of a light chain variable region set forth as SEQ ID NO: 3872; or (q-xxxiv) three CDRs of a heavy chain variable region set forth as SEQ ID NO: 3873 and three CDRs of a light chain variable region set forth as SEQ ID NO: 3874; or (r-xxxiv) three CDRs of a heavy chain variable region set forth as SEQ ID NO: 3875 and three CDRs of a light chain variable region set forth as SEQ ID NO: 3876; or (s-xxxiv) three CDRs of a heavy chain variable region set forth as SEQ ID NO: 3877 and three CDRs of a light chain variable region set forth as SEQ ID NO: 3878; or (t-xxxiv) three CDRs of a heavy chain variable region set forth as SEQ ID NO: 3879 and three CDRs of a light chain variable region set forth as SEQ ID NO: 3880; or (u-xxxiv) three CDRs of a heavy chain variable region set forth as SEQ ID NO: 3881 and three CDRs of a light chain variable region set forth as SEQ ID NO: 3882; or (v-xxxiv) three CDRs of a heavy chain variable region set forth as SEQ ID NO: 3883 and three CDRs of a light chain variable region set forth as SEQ ID NO: 3884; or (w-xxxiv) three CDRs of a heavy chain variable region set forth as SEQ ID NO: 3885 and three CDRs of a light chain variable region set forth as SEQ ID NO: 3886; or (x-xxxiv) three CDRs of a heavy chain variable region set forth as SEQ ID NO: 3887 and three CDRs of a light chain variable region set forth as SEQ ID NO: 3888; or (y-xxxiv) three CDRs of a heavy chain variable region set forth as SEQ ID NO: 3889 and three CDRs of a light chain variable region set forth as SEQ ID NO: 3890; or (z-xxxiv) three CDRs of a heavy chain variable region set forth as SEQ ID NO: 3891 and three CDRs of a light chain variable region set forth as SEQ ID NO: 3892; or (a-xxxv) three CDRs of a heavy chain variable region set forth as SEQ ID NO: 3893 and three CDRs of a light chain variable region set forth as SEQ ID NO: 3894; or (b-xxxv) three CDRs of a heavy chain variable region set forth as SEQ ID NO: 3895 and three CDRs of a light chain variable region set forth as SEQ ID NO: 3896; or (c-xxxv) three CDRs of a heavy chain variable region set forth as SEQ ID NO: 3897 and three CDRs of a light chain variable region set forth as SEQ ID NO: 3898; or (d-xxxv) three CDRs of a heavy chain variable region set forth as SEQ ID NO: 3899 and three CDRs of a light chain variable region set forth as SEQ ID NO: 3900; or (e-xxxv) three CDRs of a heavy chain variable region set forth as SEQ ID NO: 3901 and three CDRs of a light chain variable region set forth as SEQ ID NO: 3902; or (f-xxxv) three CDRs of a heavy chain variable region set forth as SEQ ID NO: 3903 and three CDRs of a light chain variable region set forth as SEQ ID NO: 3904; or (g-xxxv) three CDRs of a heavy chain variable region set forth as SEQ ID NO: 3905 and three CDRs of a light chain variable region set forth as SEQ ID NO: 3906; or (h-xxxv) three CDRs of a heavy chain variable region set forth as SEQ ID NO: 3907 and three CDRs of a light chain variable region set forth as SEQ ID NO: 3908; or (i-xxxv) three CDRs of a heavy chain variable region set forth as SEQ ID NO: 3909 and three CDRs of a light chain variable region set forth as SEQ ID NO: 3910; or (j-xxxv) three CDRs of a heavy chain variable region set forth as SEQ ID NO: 3911 and three CDRs of a light chain variable region set forth as SEQ ID NO: 3912; or (k-xxxv) three CDRs of a heavy chain variable region set forth as SEQ ID NO: 3913 and three CDRs of a light chain variable region set forth as SEQ ID NO: 3914; or (l-xxxv) three CDRs of a heavy chain variable region set forth as SEQ ID NO: 3915 and three CDRs of a light chain variable region set forth as SEQ ID NO: 3916; or (m-xxxv) three CDRs of a heavy chain variable region set forth as SEQ ID NO: 3917 and three CDRs of a light chain variable region set forth as SEQ ID NO: 3918; or (n-xxxv) three CDRs of a heavy chain variable region set forth as SEQ ID NO: 3919 and three CDRs of a light chain variable region set forth as SEQ ID NO: 3920; or (o-xxxv) three CDRs of a heavy chain variable region set forth as SEQ ID NO: 3921 and three CDRs of a light chain variable region set forth as SEQ ID NO: 3922; or (p-xxxv) three CDRs of a heavy chain variable region set forth as SEQ ID NO: 3923 and three CDRs of a light chain variable region set forth as SEQ ID NO: 3924; or (q-xxxv) three CDRs of a heavy chain variable region set forth as SEQ ID NO: 3925 and three CDRs of a light chain variable region set forth as SEQ ID NO: 3926; or (r-xxxv) three CDRs of a heavy chain variable region set forth as SEQ ID NO: 3927 and three CDRs of a light chain variable region set forth as SEQ ID NO: 3928; or (s-xxxv) three CDRs of a heavy chain variable region set forth as SEQ ID NO: 3929 and three CDRs of a light chain variable region set forth as SEQ ID NO: 3930; or (t-xxxv) three CDRs of a heavy chain variable region set forth as SEQ ID NO: 3931 and three CDRs of a light chain variable region set forth as SEQ ID NO: 3932; or (u-xxxv) three CDRs of a heavy chain variable region set forth as SEQ ID NO: 3933 and three CDRs of a light chain variable region set forth as SEQ ID NO: 3934; or (v-xxxv) three CDRs of a heavy chain variable region set forth as SEQ ID NO: 3935 and three CDRs of a light chain variable region set forth as SEQ ID NO: 3936; or (w-xxxv) three CDRs of a heavy chain variable region set forth as SEQ ID NO: 3937 and three CDRs of a light chain variable region set forth as SEQ ID NO: 3938; or (x-xxxv) three CDRs of a heavy chain variable region set forth as SEQ ID NO: 3939 and three CDRs of a light chain variable region set forth as SEQ ID NO: 3940; or (y-xxxv) three CDRs of a heavy chain variable region set forth as SEQ ID NO: 3941 and three CDRs of a light chain variable region set forth as SEQ ID NO: 3942; or (z-xxxv) three CDRs of a heavy chain variable region set forth as SEQ ID NO: 3943 and three CDRs of a light chain variable region set forth as SEQ ID NO: 3944; or (a-xxxvi) three CDRs of a heavy chain variable region set forth as SEQ ID NO: 3945 and three CDRs of a light chain variable region set forth as SEQ ID NO: 3946; or (b-xxxvi) three CDRs of a heavy chain variable region set forth as SEQ ID NO: 3947 and three CDRs of a light chain variable region set forth as SEQ ID NO: 3948; or (c-xxxvi) three CDRs of a heavy chain variable region set forth as SEQ ID NO: 3949 and three CDRs of a light chain variable region set forth as SEQ ID NO: 3950; or (d-xxxvi) three CDRs of a heavy chain variable region set forth as SEQ ID NO: 3951 and three CDRs of a light chain variable region set forth as SEQ ID NO: 3952; or (e-xxxvi) three CDRs of a heavy chain variable region set forth as SEQ ID NO: 3953 and three CDRs of a light chain variable region set forth as SEQ ID NO: 3954; or (f-xxxvi) three CDRs of a heavy chain variable region set forth as SEQ ID NO: 3955 and three CDRs of a light chain variable region set forth as SEQ ID NO: 3956; or (g-xxxvi) three CDRs of a heavy chain variable region set forth as SEQ ID NO: 3957 and three CDRs of a light chain variable region set forth as SEQ ID NO: 3958; or (h-xxxvi) three CDRs of a heavy chain variable region set forth as SEQ ID NO: 3959 and three CDRs of a light chain variable region set forth as SEQ ID NO: 3960; or (i-xxxvi) three CDRs of a heavy chain variable region set forth as SEQ ID NO: 3961 and three CDRs of a light chain variable region set forth as SEQ ID NO: 3962; or (j-xxxvi) three CDRs of a heavy chain variable region set forth as SEQ ID NO: 3963 and three CDRs of a light chain variable region set forth as SEQ ID NO: 3964; or (k-xxxvi) three CDRs of a heavy chain variable region set forth as SEQ ID NO: 3965 and three CDRs of a light chain variable region set forth as SEQ ID NO: 3966; or (l-xxxvi) three CDRs of a heavy chain variable region set forth as SEQ ID NO: 3967 and three CDRs of a light chain variable region set forth as SEQ ID NO: 3968; or (m-xxxvi) three CDRs of a heavy chain variable region set forth as SEQ ID NO: 3969 and three CDRs of a light chain variable region set forth as SEQ ID NO: 3970; or (n-xxxvi) three CDRs of a heavy chain variable region set forth as SEQ ID NO: 3971 and three CDRs of a light chain variable region set forth as SEQ ID NO: 3972; or (o-xxxvi) three CDRs of a heavy chain variable region set forth as SEQ ID NO: 3973 and three CDRs of a light chain variable region set forth as SEQ ID NO: 3974; or (p-xxxvi) three CDRs of a heavy chain variable region set forth as SEQ ID NO: 3975 and three CDRs of a light chain variable region set forth as SEQ ID NO: 3976; or (q-xxxvi) three CDRs of a heavy chain variable region set forth as SEQ ID NO: 3977 and three CDRs of a light chain variable region set forth as SEQ ID NO: 3978; or (r-xxxvi) three CDRs of a heavy chain variable region set forth as SEQ ID NO: 3979 and three CDRs of a light chain variable region set forth as SEQ ID NO: 3980; or (s-xxxvi) three CDRs of a heavy chain variable region set forth as SEQ ID NO: 3981 and three CDRs of a light chain variable region set forth as SEQ ID NO: 3982; or (t-xxxvi) three CDRs of a heavy chain variable region set forth as SEQ ID NO: 3983 and three CDRs of a light chain variable region set forth as SEQ ID NO: 3984; or (u-xxxvi) three CDRs of a heavy chain variable region set forth as SEQ ID NO: 3985 and three CDRs of a light chain variable region set forth as SEQ ID NO: 3986; or (v-xxxvi) three CDRs of a heavy chain variable region set forth as SEQ ID NO: 3987 and three CDRs of a light chain variable region set forth as SEQ ID NO: 3988; or (w-xxxvi) three CDRs of a heavy chain variable region set forth as SEQ ID NO: 3989 and three CDRs of a light chain variable region set forth as SEQ ID NO: 3990; or (x-xxxvi) three CDRs of a heavy chain variable region set forth as SEQ ID NO: 3991 and three CDRs of a light chain variable region set forth as SEQ ID NO: 3992; or (y-xxxvi) three CDRs of a heavy chain variable region set forth as SEQ ID NO: 3993 and three CDRs of a light chain variable region set forth as SEQ ID NO: 3994; or (z-xxxvi) three CDRs of a heavy chain variable region set forth as SEQ ID NO: 3995 and three CDRs of a light chain variable region set forth as SEQ ID NO: 3996; or (a-xxxvii) three CDRs of a heavy chain variable region set forth as SEQ ID NO: 3997 and three CDRs of a light chain variable region set forth as SEQ ID NO: 3998; or (b-xxxvii) three CDRs of a heavy chain variable region set forth as SEQ ID NO: 3999 and three CDRs of a light chain variable region set forth as SEQ ID NO: 4000; or (c-xxxvii) three CDRs of a heavy chain variable region set forth as SEQ ID NO: 4001 and three CDRs of a light chain variable region set forth as SEQ ID NO: 4002; or (d-xxxvii) three CDRs of a heavy chain variable region set forth as SEQ ID NO: 4003 and three CDRs of a light chain variable region set forth as SEQ ID NO: 4004; or (e-xxxvii) three CDRs of a heavy chain variable region set forth as SEQ ID NO: 4005 and three CDRs of a light chain variable region set forth as SEQ ID NO: 4006; or (f-xxxvii) three CDRs of a heavy chain variable region set forth as SEQ ID NO: 4007 and three CDRs of a light chain variable region set forth as SEQ ID NO: 4008; or (g-xxxvii) three CDRs of a heavy chain variable region set forth as SEQ ID NO: 4009 and three CDRs of a light chain variable region set forth as SEQ ID NO: 4010; or (h-xxxvii) three CDRs of a heavy chain variable region set forth as SEQ ID NO: 4011 and three CDRs of a light chain variable region set forth as SEQ ID NO: 4012; or (i-xxxvii) three CDRs of a heavy chain variable region set forth as SEQ ID NO: 4013 and three CDRs of a light chain variable region set forth as SEQ ID NO: 4014; or (j-xxxvii) three CDRs of a heavy chain variable region set forth as SEQ ID NO: 4015 and three CDRs of a light chain variable region set forth as SEQ ID NO: 4016; or (k-xxxvii) three CDRs of a heavy chain variable region set forth as SEQ ID NO: 4017 and three CDRs of a light chain variable region set forth as SEQ ID NO: 4018; or (l-xxxvii) three CDRs of a heavy chain variable region set forth as SEQ ID NO: 4019 and three CDRs of a light chain variable region set forth as SEQ ID NO: 4020; or (m-xxxvii) three CDRs of a heavy chain variable region set forth as SEQ ID NO: 4021 and three CDRs of a light chain variable region set forth as SEQ ID NO: 4022; or (n-xxxvii) three CDRs of a heavy chain variable region set forth as SEQ ID NO: 4023 and three CDRs of a light chain variable region set forth as SEQ ID NO: 4024; or (o-xxxvii) three CDRs of a heavy chain variable region set forth as SEQ ID NO: 4025 and three CDRs of a light chain variable region set forth as SEQ ID NO: 4026; or (p-xxxvii) three CDRs of a heavy chain variable region set forth as SEQ ID NO: 4027 and three CDRs of a light chain variable region set forth as SEQ ID NO: 4028; or (q-xxxvii) three CDRs of a heavy chain variable region set forth as SEQ ID NO: 4029 and three CDRs of a light chain variable region set forth as SEQ ID NO: 4030; or (r-xxxvii) three CDRs of a heavy chain variable region set forth as SEQ ID NO: 4031 and three CDRs of a light chain variable region set forth as SEQ ID NO: 4032; or (s-xxxvii) three CDRs of a heavy chain variable region set forth as SEQ ID NO: 4033 and three CDRs of a light chain variable region set forth as SEQ ID NO: 4034; or (t-xxxvii) three CDRs of a heavy chain variable region set forth as SEQ ID NO: 4035 and three CDRs of a light chain variable region set forth as SEQ ID NO: 4036; or (u-xxxvii) three CDRs of a heavy chain variable region set forth as SEQ ID NO: 4037 and three CDRs of a light chain variable region set forth as SEQ ID NO: 4038; or (v-xxxvii) three CDRs of a heavy chain variable region set forth as SEQ ID NO: 4039 and three CDRs of a light chain variable region set forth as SEQ ID NO: 4040; or (w-xxxvii) three CDRs of a heavy chain variable region set forth as SEQ ID NO: 4041 and three CDRs of a light chain variable region set forth as SEQ ID NO: 4042; or (x-xxxvii) three CDRs of a heavy chain variable region set forth as SEQ ID NO: 4043 and three CDRs of a light chain variable region set forth as SEQ ID NO: 4044; or (y-xxxvii) three CDRs of a heavy chain variable region set forth as SEQ ID NO: 4045 and three CDRs of a light chain variable region set forth as SEQ ID NO: 4046; or (z-xxxvii) three CDRs of a heavy chain variable region set forth as SEQ ID NO: 4047 and three CDRs of a light chain variable region set forth as SEQ ID NO: 4048; or (a-xxxviii) three CDRs of a heavy chain variable region set forth as SEQ ID NO: 4049 and three CDRs of a light chain variable region set forth as SEQ ID NO: 4050; or (b-xxxviii) three CDRs of a heavy chain variable region set forth as SEQ ID NO: 4051 and three CDRs of a light chain variable region set forth as SEQ ID NO: 4052; or (c-xxxviii) three CDRs of a heavy chain variable region set forth as SEQ ID NO: 4053 and three CDRs of a light chain variable region set forth as SEQ ID NO: 4054; or (d-xxxviii) three CDRs of a heavy chain variable region set forth as SEQ ID NO: 4055 and three CDRs of a light chain variable region set forth as SEQ ID NO: 4056; or (e-xxxviii) three CDRs of a heavy chain variable region set forth as SEQ ID NO: 4057 and three CDRs of a light chain variable region set forth as SEQ ID NO: 4058; or (f-xxxviii) three CDRs of a heavy chain variable region set forth as SEQ ID NO: 4059 and three CDRs of a light chain variable region set forth as SEQ ID NO: 4060; or (g-xxxviii) three CDRs of a heavy chain variable region set forth as SEQ ID NO: 4061 and three CDRs of a light chain variable region set forth as SEQ ID NO: 4062; or (h-xxxviii) three CDRs of a heavy chain variable region set forth as SEQ ID NO: 4063 and three CDRs of a light chain variable region set forth as SEQ ID NO: 4064; or (i-xxxviii) three CDRs of a heavy chain variable region set forth as SEQ ID NO: 4065 and three CDRs of a light chain variable region set forth as SEQ ID NO: 4066; or (j-xxxviii) three CDRs of a heavy chain variable region set forth as SEQ ID NO: 4067 and three CDRs of a light chain variable region set forth as SEQ ID NO: 4068; or (k-xxxviii) three CDRs of a heavy chain variable region set forth as SEQ ID NO: 4069 and three CDRs of a light chain variable region set forth as SEQ ID NO: 4070; or (l-xxxviii) three CDRs of a heavy chain variable region set forth as SEQ ID NO: 4071 and three CDRs of a light chain variable region set forth as SEQ ID NO: 4072; or (m-xxxviii) three CDRs of a heavy chain variable region set forth as SEQ ID NO: 4073 and three CDRs of a light chain variable region set forth as SEQ ID NO: 4074; or (n-xxxviii) three CDRs of a heavy chain variable region set forth as SEQ ID NO: 4075 and three CDRs of a light chain variable region set forth as SEQ ID NO: 4076; or (o-xxxviii) three CDRs of a heavy chain variable region set forth as SEQ ID NO: 4077 and three CDRs of a light chain variable region set forth as SEQ ID NO: 4078; or (p-xxxviii) three CDRs of a heavy chain variable region set forth as SEQ ID NO: 4079 and three CDRs of a light chain variable region set forth as SEQ ID NO: 4080; or (q-xxxviii) three CDRs of a heavy chain variable region set forth as SEQ ID NO: 4081 and three CDRs of a light chain variable region set forth as SEQ ID NO: 4082; or (r-xxxviii) three CDRs of a heavy chain variable region set forth as SEQ ID NO: 4083 and three CDRs of a light chain variable region set forth as SEQ ID NO: 4084; or (s-xxxviii) three CDRs of a heavy chain variable region set forth as SEQ ID NO: 4085 and three CDRs of a light chain variable region set forth as SEQ ID NO: 4086; or (t-xxxviii) three CDRs of a heavy chain variable region set forth as SEQ ID NO: 4087 and three CDRs of a light chain variable region set forth as SEQ ID NO: 4088; or (u-xxxviii) three CDRs of a heavy chain variable region set forth as SEQ ID NO: 4089 and three CDRs of a light chain variable region set forth as SEQ ID NO: 4090; or (v-xxxviii) three CDRs of a heavy chain variable region set forth as SEQ ID NO: 4091 and three CDRs of a light chain variable region set forth as SEQ ID NO: 4092; or (w-xxxviii) three CDRs of a heavy chain variable region set forth as SEQ ID NO: 4093 and three CDRs of a light chain variable region set forth as SEQ ID NO: 4094; or (x-xxxviii) three CDRs of a heavy chain variable region set forth as SEQ ID NO: 4095 and three CDRs of a light chain variable region set forth as SEQ ID NO: 4096; or (y-xxxviii) three CDRs of a heavy chain variable region set forth as SEQ ID NO: 4097 and three CDRs of a light chain variable region set forth as SEQ ID NO: 4098; or (z-xxxviii) three CDRs of a heavy chain variable region set forth as SEQ ID NO: 4099 and three CDRs of a light chain variable region set forth as SEQ ID NO: 4100; or (a-xxxix) three CDRs of a heavy chain variable region set forth as SEQ ID NO: 4101 and three CDRs of a light chain variable region set forth as SEQ ID NO: 4102; or (b-xxxix) three CDRs of a heavy chain variable region set forth as SEQ ID NO: 4103 and three CDRs of a light chain variable region set forth as SEQ ID NO: 4104; or (c-xxxix) three CDRs of a heavy chain variable region set forth as SEQ ID NO: 4105 and three CDRs of a light chain variable region set forth as SEQ ID NO: 4106; or (d-xxxix) three CDRs of a heavy chain variable region set forth as SEQ ID NO: 4107 and three CDRs of a light chain variable region set forth as SEQ ID NO: 4108; or (e-xxxix) three CDRs of a heavy chain variable region set forth as SEQ ID NO: 4109 and three CDRs of a light chain variable region set forth as SEQ ID NO: 4110; or (f-xxxix) three CDRs of a heavy chain variable region set forth as SEQ ID NO: 4111 and three CDRs of a light chain variable region set forth as SEQ ID NO: 4112; or (g-xxxix) three CDRs of a heavy chain variable region set forth as SEQ ID NO: 4113 and three CDRs of a light chain variable region set forth as SEQ ID NO: 4114; or (h-xxxix) three CDRs of a heavy chain variable region set forth as SEQ ID NO: 4115 and three CDRs of a light chain variable region set forth as SEQ ID NO: 4116; or (i-xxxix) three CDRs of a heavy chain variable region set forth as SEQ ID NO: 4117 and three CDRs of a light chain variable region set forth as SEQ ID NO: 4118; or (j-xxxix) three CDRs of a heavy chain variable region set forth as SEQ ID NO: 4119 and three CDRs of a light chain variable region set forth as SEQ ID NO: 4120; or (k-xxxix) three CDRs of a heavy chain variable region set forth as SEQ ID NO: 4121 and three CDRs of a light chain variable region set forth as SEQ ID NO: 4122; or (l-xxxix) three CDRs of a heavy chain variable region set forth as SEQ ID NO: 4123 and three CDRs of a light chain variable region set forth as SEQ ID NO: 4124; or (m-xxxix) three CDRs of a heavy chain variable region set forth as SEQ ID NO: 4125 and three CDRs of a light chain variable region set forth as SEQ ID NO: 4126; or (n-xxxix) three CDRs of a heavy chain variable region set forth as SEQ ID NO: 4127 and three CDRs of a light chain variable region set forth as SEQ ID NO: 4128; or (o-xxxix) three CDRs of a heavy chain variable region set forth as SEQ ID NO: 4129 and three CDRs of a light chain variable region set forth as SEQ ID NO: 4130; or (p-xxxix) three CDRs of a heavy chain variable region set forth as SEQ ID NO: 4131 and three CDRs of a light chain variable region set forth as SEQ ID NO: 4132; or (q-xxxix) three CDRs of a heavy chain variable region set forth as SEQ ID NO: 4133 and three CDRs of a light chain variable region set forth as SEQ ID NO: 4134; or (r-xxxix) three CDRs of a heavy chain variable region set forth as SEQ ID NO: 4135 and three CDRs of a light chain variable region set forth as SEQ ID NO: 4136; or (s-xxxix) three CDRs of a heavy chain variable region set forth as SEQ ID NO: 4137 and three CDRs of a light chain variable region set forth as SEQ ID NO: 4138; or (t-xxxix) three CDRs of a heavy chain variable region set forth as SEQ ID NO: 4139 and three CDRs of a light chain variable region set forth as SEQ ID NO: 4140; or (u-xxxix) three CDRs of a heavy chain variable region set forth as SEQ ID NO: 4141 and three CDRs of a light chain variable region set forth as SEQ ID NO: 4142; or (v-xxxix) three CDRs of a heavy chain variable region set forth as SEQ ID NO: 4143 and three CDRs of a light chain variable region set forth as SEQ ID NO: 4144; or (w-xxxix) three CDRs of a heavy chain variable region set forth as SEQ ID NO: 4145 and three CDRs of a light chain variable region set forth as SEQ ID NO: 4146; or (x-xxxix) three CDRs of a heavy chain variable region set forth as SEQ ID NO: 4147 and three CDRs of a light chain variable region set forth as SEQ ID NO: 4148; or (y-xxxix) three CDRs of a heavy chain variable region set forth as SEQ ID NO: 4149 and three CDRs of a light chain variable region set forth as SEQ ID NO: 4150; or (z-xxxix) three CDRs of a heavy chain variable region set forth as SEQ ID NO: 4151 and three CDRs of a light chain variable region set forth as SEQ ID NO: 4152; or (a-xl) three CDRs of a heavy chain variable region set forth as SEQ ID NO: 4153 and three CDRs of a light chain variable region set forth as SEQ ID NO: 4154; or (b-xl) three CDRs of a heavy chain variable region set forth as SEQ ID NO: 4155 and three CDRs of a light chain variable region set forth as SEQ ID NO: 4156; or (c-xl) three CDRs of a heavy chain variable region set forth as SEQ ID NO: 4157 and three CDRs of a light chain variable region set forth as SEQ ID NO: 4158; or (d-xl) three CDRs of a heavy chain variable region set forth as SEQ ID NO: 4159 and three CDRs of a light chain variable region set forth as SEQ ID NO: 4160; or (e-xl) three CDRs of a heavy chain variable region set forth as SEQ ID NO: 4161 and three CDRs of a light chain variable region set forth as SEQ ID NO: 4162; or (f-xl) three CDRs of a heavy chain variable region set forth as SEQ ID NO: 4163 and three CDRs of a light chain variable region set forth as SEQ ID NO: 4164; or (g-xl) three CDRs of a heavy chain variable region set forth as SEQ ID NO: 4165 and three CDRs of a light chain variable region set forth as SEQ ID NO: 4166; or (h-xl) three CDRs of a heavy chain variable region set forth as SEQ ID NO: 4167 and three CDRs of a light chain variable region set forth as SEQ ID NO: 4168; or (i-xl) three CDRs of a heavy chain variable region set forth as SEQ ID NO: 4169 and three CDRs of a light chain variable region set forth as SEQ ID NO: 4170; or (j-xl) three CDRs of a heavy chain variable region set forth as SEQ ID NO: 4171 and three CDRs of a light chain variable region set forth as SEQ ID NO: 4172; or (k-xl) three CDRs of a heavy chain variable region set forth as SEQ ID NO: 4173 and three CDRs of a light chain variable region set forth as SEQ ID NO: 4174; or (l-xl) three CDRs of a heavy chain variable region set forth as SEQ ID NO: 4175 and three CDRs of a light chain variable region set forth as SEQ ID NO: 4176; or (m-xl) three CDRs of a heavy chain variable region set forth as SEQ ID NO: 4177 and three CDRs of a light chain variable region set forth as SEQ ID NO: 4178; or (n-xl) three CDRs of a heavy chain variable region set forth as SEQ ID NO: 4179 and three CDRs of a light chain variable region set forth as SEQ ID NO: 4180; or (o-xl) three CDRs of a heavy chain variable region set forth as SEQ ID NO: 4749 and three CDRs of a light chain variable region set forth as SEQ ID NO: 4750; or (p-xl) three CDRs of a heavy chain variable region set forth as SEQ ID NO: 4751 and three CDRs of a light chain variable region set forth as SEQ ID NO: 4752; or (q-xl) three CDRs of a heavy chain variable region set forth as SEQ ID NO: 4753 and three CDRs of a light chain variable region set forth as SEQ ID NO: 4754; or (r-xl) three CDRs of a heavy chain variable region set forth as SEQ ID NO: 4755 and three CDRs of a light chain variable region set forth as SEQ ID NO: 4756; or (s-xl) three CDRs of a heavy chain variable region set forth as SEQ ID NO: 4757 and three CDRs of a light chain variable region set forth as SEQ ID NO: 4758; or (t-xl) three CDRs of a heavy chain variable region set forth as SEQ ID NO: 4759 and three CDRs of a light chain variable region set forth as SEQ ID NO: 4760; or (u-xl) three CDRs of a heavy chain variable region set forth as SEQ ID NO: 4761 and three CDRs of a light chain variable region set forth as SEQ ID NO: 4762; or (v-xl) three CDRs of a heavy chain variable region set forth as SEQ ID NO: 4763 and three CDRs of a light chain variable region set forth as SEQ ID NO: 4764; or (w-xl) three CDRs of a heavy chain variable region set forth as SEQ ID NO: 4765 and three CDRs of a light chain variable region set forth as SEQ ID NO: 4766; or
(x-xl) three CDRs of a heavy chain variable region set forth as SEQ ID NO: 4767 and three CDRs of a light chain variable region set forth as SEQ ID NO: 4768; or
(y-xl) three CDRs of a heavy chain variable region set forth as SEQ ID NO: 4769 and three CDRs of a light chain variable region set forth as SEQ ID NO: 4770; or
(z-xl) three CDRs of a heavy chain variable region set forth as SEQ ID NO: 4771 and three CDRs of a light chain variable region set forth as SEQ ID NO: 4772; or
(a-xli) three CDRs of a heavy chain variable region set forth as SEQ ID NO: 4773 and three CDRs of a light chain variable region set forth as SEQ ID NO: 4774; or
(b-xli) three CDRs of a heavy chain variable region set forth as SEQ ID NO: 4775 and three CDRs of a light chain variable region set forth as SEQ ID NO: 4776; or
(c-xli) three CDRs of a heavy chain variable region set forth as SEQ ID NO: 4777 and three CDRs of a light chain variable region set forth as SEQ ID NO: 4778; or
(d-xli) three CDRs of a heavy chain variable region set forth as SEQ ID NO: 4779 and three CDRs of a light chain variable region set forth as SEQ ID NO: 4780; or
(e-xli) three CDRs of a heavy chain variable region set forth as SEQ ID NO: 4781 and three CDRs of a light chain variable region set forth as SEQ ID NO: 4782; or
(f-xli) three CDRs of a heavy chain variable region set forth as SEQ ID NO: 4783 and three CDRs of a light chain variable region set forth as SEQ ID NO: 4784; or
(g-xli) three CDRs of a heavy chain variable region set forth as SEQ ID NO: 4785 and three CDRs of a light chain variable region set forth as SEQ ID NO: 4786; or
(h-xli) three CDRs of a heavy chain variable region set forth as SEQ ID NO: 4787 and three CDRs of a light chain variable region set forth as SEQ ID NO: 4788; or
(i-xli) three CDRs of a heavy chain variable region set forth as SEQ ID NO: 4789 and three CDRs of a light chain variable region set forth as SEQ ID NO: 4790; or
(j-xli) three CDRs of a heavy chain variable region set forth as SEQ ID NO: 4791 and three CDRs of a light chain variable region set forth as SEQ ID NO: 4792; or
(k-xli) three CDRs of a heavy chain variable region set forth as SEQ ID NO: 4793 and three CDRs of a light chain variable region set forth as SEQ ID NO: 4794: or
(l-xli) three CDRs of a heavy chain variable region set forth as SEQ ID NO: 4795 and three CDRs of a light chain variable region set forth as SEQ ID NO: 4796: or
(m-xli) three CDRs of a heavy chain variable region set forth as SEQ ID NO: 4797 and three CDRs of a light chain variable region set forth as SEQ ID NO: 4798: or
(n-xli) three CDRs of a heavy chain variable region set forth as SEQ ID NO: 4799 and three CDRs of a light chain variable region set forth as SEQ ID NO: 4800: or
(o-xli) three CDRs of a heavy chain variable region set forth as SEQ ID NO: 4801 and three CDRs of a light chain variable region set forth as SEQ ID NO: 4802; or
(p-xli) three CDRs of a heavy chain variable region set forth as SEQ ID NO: 4803 and three CDRs of a light chain variable region set forth as SEQ ID NO: 4804; or
(q-xli) three CDRs of a heavy chain variable region set forth as SEQ ID NO: 4805 and three CDRs of a light chain variable region set forth as SEQ ID NO: 4806; or
(r-xli) three CDRs of a heavy chain variable region set forth as SEQ ID NO: 4807 and three CDRs of a light chain variable region set forth as SEQ ID NO: 4808; or
(s-xli) three CDRs of a heavy chain variable region set forth as SEQ ID NO: 4809 and three CDRs of a light chain variable region set forth as SEQ ID NO: 4810; or
(t-xli) three CDRs of a heavy chain variable region set forth as SEQ ID NO: 4811 and three CDRs of a light chain variable region set forth as SEQ ID NO: 4812; or
(u-xli) three CDRs of a heavy chain variable region set forth as SEQ ID NO: 4813 and three CDRs of a light chain variable region set forth as SEQ ID NO: 4814; or
(v-xli) three CDRs of a heavy chain variable region set forth as SEQ ID NO: 4815 and three CDRs of a light chain variable region set forth as SEQ ID NO: 4816; or
(w-xli) three CDRs of a heavy chain variable region set forth as SEQ ID NO: 4817 and three CDRs of a light chain variable region set forth as SEQ ID NO: 4818; or
(x-xli) three CDRs of a heavy chain variable region set forth as SEQ ID NO: 4819 and three CDRs of a light chain variable region set forth as SEQ ID NO: 4820; or
(y-xli) three CDRs of a heavy chain variable region set forth as SEQ ID NO: 4821 and three CDRs of a light chain variable region set forth as SEQ ID NO: 4822; or
(z-xli) three CDRs of a heavy chain variable region set forth as SEQ ID NO: 4823 and three CDRs of a light chain variable region set forth as SEQ ID NO: 4824; or
(a-xlii) three CDRs of a heavy chain variable region set forth as SEQ ID NO: 4825 and three CDRs of a light chain variable region set forth as SEQ ID NO: 4826; or
(b-xlii) three CDRs of a heavy chain variable region set forth as SEQ ID NO: 4827 and three CDRs of a light chain variable region set forth as SEQ ID NO: 4828; or
(c-xlii) three CDRs of a heavy chain variable region set forth as SEQ ID NO: 4829 and three CDRs of a light chain variable region set forth as SEQ ID NO: 4830; or
(d-xlii) three CDRs of a heavy chain variable region set forth as SEQ ID NO: 4831 and three CDRs of a light chain variable region set forth as SEQ ID NO: 4832; or
(e-xlii) three CDRs of a heavy chain variable region set forth as SEQ ID NO: 4833 and three CDRs of a light chain variable region set forth as SEQ ID NO: 4834; or
(f-xlii) three CDRs of a heavy chain variable region set forth as SEQ ID NO: 4835 and three CDRs of a light chain variable region set forth as SEQ ID NO: 4836; or
(g-xlii) three CDRs of a heavy chain variable region set forth as SEQ ID NO: 4837 and three CDRs of a light chain variable region set forth as SEQ ID NO: 4838; or
(h-xlii) three CDRs of a heavy chain variable region set forth as SEQ ID NO: 4839 and three CDRs of a light chain variable region set forth as SEQ ID NO: 4840; or
(i-xlii) three CDRs of a heavy chain variable region set forth as SEQ ID NO: 4841 and three CDRs of a light chain variable region set forth as SEQ ID NO: 4842; or
(j-xlii) three CDRs of a heavy chain variable region set forth as SEQ ID NO: 4843 and three CDRs of a light chain variable region set forth as SEQ ID NO: 4844; or
(k-xlii) three CDRs of a heavy chain variable region set forth as SEQ ID NO: 4845 and three CDRs of a light chain variable region set forth as SEQ ID NO: 4846; or
(l-xlii) three CDRs of a heavy chain variable region set forth as SEQ ID NO: 4847 and three CDRs of a light chain variable region set forth as SEQ ID NO: 4848; or
(m-xlii) three CDRs of a heavy chain variable region set forth as SEQ ID NO: 4849 and three CDRs of a light chain variable region set forth as SEQ ID NO: 4850; or
(n-xlii) three CDRs of a heavy chain variable region set forth as SEQ ID NO: 4851 and three CDRs of a light chain variable region set forth as SEQ ID NO: 4852; or (o-xlii) three CDRs of a heavy chain variable region set forth as SEQ ID NO: 4853 and three CDRs of a light chain variable region set forth as SEQ ID NO: 4854; or (p-xlii) three CDRs of a heavy chain variable region set forth as SEQ ID NO: 4855 and three CDRs of a light chain variable region set forth as SEQ ID NO: 4856; or (q-xlii) three CDRs of a heavy chain variable region set forth as SEQ ID NO: 4857 and three CDRs of a light chain variable region set forth as SEQ ID NO: 4858; or (r-xlii) three CDRs of a heavy chain variable region set forth as SEQ ID NO: 4859 and three CDRs of a light chain variable region set forth as SEQ ID NO: 4860; or (s-xlii) three CDRs of a heavy chain variable region set forth as SEQ ID NO: 4861 and three CDRs of a light chain variable region set forth as SEQ ID NO: 4862; or (t-xlii) three CDRs of a heavy chain variable region set forth as SEQ ID NO: 4863 and three CDRs of a light chain variable region set forth as SEQ ID NO: 4864; or (u-xlii) three CDRs of a heavy chain variable region set forth as SEQ ID NO: 4865 and three CDRs of a light chain variable region set forth as SEQ ID NO: 4866; or (v-xlii) three CDRs of a heavy chain variable region set forth as SEQ ID NO: 4867 and three CDRs of a light chain variable region set forth as SEQ ID NO: 4868; or (w-xlii) three CDRs of a heavy chain variable region set forth as SEQ ID NO: 4869 and three CDRs of a light chain variable region set forth as SEQ ID NO: 4870; or (x-xlii) three CDRs of a heavy chain variable region set forth as SEQ ID NO: 4871 and three CDRs of a light chain variable region set forth as SEQ ID NO: 4872; or (y-xlii) three CDRs of a heavy chain variable region set forth as SEQ ID NO: 4873 and three CDRs of a light chain variable region set forth as SEQ ID NO: 4874; or (z-xlii) three CDRs of a heavy chain variable region set forth as SEQ ID NO: 4875 and three CDRs of a light chain variable region set forth as SEQ ID NO: 4876; or (a-xliii) three CDRs of a heavy chain variable region set forth as SEQ ID NO: 4877 and three CDRs of a light chain variable region set forth as SEQ ID NO: 4878; or (b-xliii) three CDRs of a heavy chain variable region set forth as SEQ ID NO: 4879 and three CDRs of a light chain variable region set forth as SEQ ID NO: 4880; or (c-xliii) three CDRs of a heavy chain variable region set forth as SEQ ID NO: 4881 and three CDRs of a light chain variable region set forth as SEQ ID NO: 4882; or (d-xliii) three CDRs of a heavy chain variable region set forth as SEQ ID NO: 4883 and three CDRs of a light chain variable region set forth as SEQ ID NO: 4884; or (e-xliii) three CDRs of a heavy chain variable region set forth as SEQ ID NO: 4885 and three CDRs of a light chain variable region set forth as SEQ ID NO: 4886; or (f-xliii) three CDRs of a heavy chain variable region set forth as SEQ ID NO: 4887 and three CDRs of a light chain variable region set forth as SEQ ID NO: 4888; or (g-xliii) three CDRs of a heavy chain variable region set forth as SEQ ID NO: 4889 and three CDRs of a light chain variable region set forth as SEQ ID NO: 4890; or (h-xliii) three CDRs of a heavy chain variable region set forth as SEQ ID NO: 4891 and three CDRs of a light chain variable region set forth as SEQ ID NO: 4892; or (i-xliii) three CDRs of a heavy chain variable region set forth as SEQ ID NO: 4893 and three CDRs of a light chain variable region set forth as SEQ ID NO: 4894; or (j-xliii) three CDRs of a heavy chain variable region set forth as SEQ ID NO: 4895 and three CDRs of a light chain variable region set forth as SEQ ID NO: 4896; or (k-xliii) three CDRs of a heavy chain variable region set forth as SEQ ID NO: 4897 and three CDRs of a light chain variable region set forth as SEQ ID NO: 4898; or (l-xliii) three CDRs of a heavy chain variable region set forth as SEQ ID NO: 4899 and three CDRs of a light chain variable region set forth as SEQ ID NO: 4900; or (m-xliii) three CDRs of a heavy chain variable region set forth as SEQ ID NO: 4901 and three CDRs of a light chain variable region set forth as SEQ ID NO: 4902; or (n-xliii) three CDRs of a heavy chain variable region set forth as SEQ ID NO: 4903 and three CDRs of a light chain variable region set forth as SEQ ID NO: 4904; or (o-xliii) three CDRs of a heavy chain variable region set forth as SEQ ID NO: 4905 and three CDRs of a light chain variable region set forth as SEQ ID NO: 4906; or (p-xliii) three CDRs of a heavy chain variable region set forth as SEQ ID NO: 4907 and three CDRs of a light chain variable region set forth as SEQ ID NO: 4908; or (q-xliii) three CDRs of a heavy chain variable region set forth as SEQ ID NO: 4909 and three CDRs of a light chain variable region set forth as SEQ ID NO: 4910; or (r-xliii) three CDRs of a heavy chain variable region set forth as SEQ ID NO: 4911 and three CDRs of a light chain variable region set forth as SEQ ID NO: 4912; or (s-xliii) three CDRs of a heavy chain variable region set forth as SEQ ID NO: 4913 and three CDRs of a light chain variable region set forth as SEQ ID NO: 4914; or (t-xliii) three CDRs of a heavy chain variable region set forth as SEQ ID NO: 4915 and three CDRs of a light chain variable region set forth as SEQ ID NO: 4916; or (u-xliii) three CDRs of a heavy chain variable region set forth as SEQ ID NO: 4917 and three CDRs of a light chain variable region set forth as SEQ ID NO: 4918; or (v-xliii) three CDRs of a heavy chain variable region set forth as SEQ ID NO: 4919 and three CDRs of a light chain variable region set forth as SEQ ID NO: 4920; or (w-xliii) three CDRs of a heavy chain variable region set forth as SEQ ID NO: 4921 and three CDRs of a light chain variable region set forth as SEQ ID NO: 4922; or (x-xliii) three CDRs of a heavy chain variable region set forth as SEQ ID NO: 4923 and three CDRs of a light chain variable region set forth as SEQ ID NO: 4924; or (y-xliii) three CDRs of a heavy chain variable region set forth as SEQ ID NO: 4925 and three CDRs of a light chain variable region set forth as SEQ ID NO: 4926; or (z-xliii) three CDRs of a heavy chain variable region set forth as SEQ ID NO: 4927 and three CDRs of a light chain variable region set forth as SEQ ID NO: 4928; or (a-xliv) three CDRs of a heavy chain variable region set forth as SEQ ID NO: 4929 and three CDRs of a light chain variable region set forth as SEQ ID NO: 4930; or (b-xliv) three CDRs of a heavy chain variable region set forth as SEQ ID NO: 4931 and three CDRs of a light chain variable region set forth as SEQ ID NO: 4932; or (c-xliv) three CDRs of a heavy chain variable region set forth as SEQ ID NO: 4933 and three CDRs of a light chain variable region set forth as SEQ ID NO: 4934; or (d-xliv) three CDRs of a heavy chain variable region set forth as SEQ ID NO: 4935 and three CDRs of a light chain variable region set forth as SEQ ID NO: 4936; or (e-xliv) three CDRs of a heavy chain variable region set forth as SEQ ID NO: 4937 and three CDRs of a light chain variable region set forth as SEQ ID NO: 4938; or (f-xliv) three CDRs of a heavy chain variable region set forth as SEQ ID NO: 4939 and three CDRs of a light chain variable region set forth as SEQ ID NO: 4940; or (g-xliv) three CDRs of a heavy chain variable region set forth as SEQ ID NO: 4941 and three CDRs of a light chain variable region set forth as SEQ ID NO: 4942; or (h-xliv) three CDRs of a heavy chain variable region set forth as SEQ ID NO: 4943 and three CDRs of a light chain variable region set forth as SEQ ID NO: 4944; or (i-xliv) three CDRs of a heavy chain variable region set forth as SEQ ID NO: 4945 and three CDRs of a light chain variable region set forth as SEQ ID NO: 4946; or (j-xliv) three CDRs of a heavy chain variable region set forth as SEQ ID NO: 4947 and three CDRs of a light chain variable region set forth as SEQ ID NO: 4948; or (k-xliv) three CDRs of a heavy chain variable region set forth as SEQ ID NO: 4949 and three CDRs of a light chain variable region set forth as SEQ ID NO: 4950; or (l-xliv) three CDRs of a heavy chain variable region set forth as SEQ ID NO: 4951 and three CDRs of a light chain variable region set forth as SEQ ID NO: 4952; or (m-xliv) three CDRs of a heavy chain variable region set forth as SEQ ID NO: 4953 and three CDRs of a light chain variable region set forth as SEQ ID NO: 4954; or (n-xliv) three CDRs of a heavy chain variable region set forth as SEQ ID NO: 4955 and three CDRs of a light chain variable region set forth as SEQ ID NO: 4956; or (o-xliv) three CDRs of a heavy chain variable region set forth as SEQ ID NO: 4957 and three CDRs of a light chain variable region set forth as SEQ ID NO: 4958; or (p-xliv) three CDRs of a heavy chain variable region set forth as SEQ ID NO: 4959 and three CDRs of a light chain variable region set forth as SEQ ID NO: 4960; or (q-xliv) three CDRs of a heavy chain variable region set forth as SEQ ID NO: 4961 and three CDRs of a light chain variable region set forth as SEQ ID NO: 4962; or (r-xliv) three CDRs of a heavy chain variable region set forth as SEQ ID NO: 4963 and three CDRs of a light chain variable region set forth as SEQ ID NO: 4964; or (s-xliv) three CDRs of a heavy chain variable region set forth as SEQ ID NO: 4965 and three CDRs of a light chain variable region set forth as SEQ ID NO: 4966; or (t-xliv) three CDRs of a heavy chain variable region set forth as SEQ ID NO: 4967 and three CDRs of a light chain variable region set forth as SEQ ID NO: 4968; or (u-xliv) three CDRs of a heavy chain variable region set forth as SEQ ID NO: 4969 and three CDRs of a light chain variable region set forth as SEQ ID NO: 4970; or (v-xliv) three CDRs of a heavy chain variable region set forth as SEQ ID NO: 4971 and three CDRs of a light chain variable region set forth as SEQ ID NO: 4972; or (w-xliv) three CDRs of a heavy chain variable region set forth as SEQ ID NO: 4973 and three CDRs of a light chain variable region set forth as SEQ ID NO: 4974; or (x-xliv) three CDRs of a heavy chain variable region set forth as SEQ ID NO: 4975 and three CDRs of a light chain variable region set forth as SEQ ID NO: 4976; or (y-xliv) three CDRs of a heavy chain variable region set forth as SEQ ID NO: 4977 and three CDRs of a light chain variable region set forth as SEQ ID NO: 4978; or (z-xliv) three CDRs of a heavy chain variable region set forth as SEQ ID NO: 4979 and three CDRs of a light chain variable region set forth as SEQ ID NO: 4980; or (a-xlv) three CDRs of a heavy chain variable region set forth as SEQ ID NO: 4981 and three CDRs of a light chain variable region set forth as SEQ ID NO: 4982; or (b-xlv) three CDRs of a heavy chain variable region set forth as SEQ ID NO: 4983 and three CDRs of a light chain variable region set forth as SEQ ID NO: 4984; or (c-xlv) three CDRs of a heavy chain variable region set forth as SEQ ID NO: 4985 and three CDRs of a light chain variable region set forth as SEQ ID NO: 4986; or (d-xlv) three CDRs of a heavy chain variable region set forth as SEQ ID NO: 4987 and three CDRs of a light chain variable region set forth as SEQ ID NO: 4988; or (e-xlv) three CDRs of a heavy chain variable region set forth as SEQ ID NO: 4989 and three CDRs of a light chain variable region set forth as SEQ ID NO: 4990; or (f-xlv) three CDRs of a heavy chain variable region set forth as SEQ ID NO: 4991 and three CDRs of a light chain variable region set forth as SEQ ID NO: 4992; or (g-xlv) three CDRs of a heavy chain variable region set forth as SEQ ID NO: 4993 and three CDRs of a light chain variable region set forth as SEQ ID NO: 4994; or (h-xlv) three CDRs of a heavy chain variable region set forth as SEQ ID NO: 4995 and three CDRs of a light chain variable region set forth as SEQ ID NO: 4996; or (i-xlv) three CDRs of a heavy chain variable region set forth as SEQ ID NO: 4997 and three CDRs of a light chain variable region set forth as SEQ ID NO: 4998; or (j-xlv) three CDRs of a heavy chain variable region set forth as SEQ ID NO: 4999 and three CDRs of a light chain variable region set forth as SEQ ID NO: 5000; or (k-xlv) three CDRs of a heavy chain variable region set forth as SEQ ID NO: 5001 and three CDRs of a light chain variable region set forth as SEQ ID NO: 5002; or (l-xlv) three CDRs of a heavy chain variable region set forth as SEQ ID NO: 5003 and three CDRs of a light chain variable region set forth as SEQ ID NO: 5004; or (m-xlv) three CDRs of a heavy chain variable region set forth as SEQ ID NO: 5005 and three CDRs of a light chain variable region set forth as SEQ ID NO: 5006; or (n-xlv) three CDRs of a heavy chain variable region set forth as SEQ ID NO: 5007 and three CDRs of a light chain variable region set forth as SEQ ID NO: 5008; or (o-xlv) three CDRs of a heavy chain variable region set forth as SEQ ID NO: 5009 and three CDRs of a light chain variable region set forth as SEQ ID NO: 5010; or (p-xlv) three CDRs of a heavy chain variable region set forth as SEQ ID NO: 5011 and three CDRs of a light chain variable region set forth as SEQ ID NO: 5012; or (q-xlv) three CDRs of a heavy chain variable region set forth as SEQ ID NO: 5013 and three CDRs of a light chain variable region set forth as SEQ ID NO: 5014; or (r-xlv) three CDRs of a heavy chain variable region set forth as SEQ ID NO: 5015 and three CDRs of a light chain variable region set forth as SEQ ID NO: 5016; or (s-xlv) three CDRs of a heavy chain variable region set forth as SEQ ID NO: 5017 and three CDRs of a light chain variable region set forth as SEQ ID NO: 5018; or (t-xlv) three CDRs of a heavy chain variable region set forth as SEQ ID NO: 5019 and three CDRs of a light chain variable region set forth as SEQ ID NO: 5020; or (u-xlv) three CDRs of a heavy chain variable region set forth as SEQ ID NO: 5021 and three CDRs of a light chain variable region set forth as SEQ ID NO: 5022; or (v-xlv) three CDRs of a heavy chain variable region set forth as SEQ ID NO: 5023 and three CDRs of a light chain variable region set forth as SEQ ID NO: 5024; or (w-xlv) three CDRs of a heavy chain variable region set forth as SEQ ID NO: 5025 and three CDRs of a light chain variable region set forth as SEQ ID NO: 5026; or (x-xlv) three CDRs of a heavy chain variable region set forth as SEQ ID NO: 5027 and three CDRs of a light chain variable region set forth as SEQ ID NO: 5028; or (y-xlv) three CDRs of a heavy chain variable region set forth as SEQ ID NO: 5029 and three CDRs of a light chain variable region set forth as SEQ ID NO: 5030; or (z-xlv) three CDRs of a heavy chain variable region set forth as SEQ ID NO: 5031 and three CDRs of a light chain variable region set forth as SEQ ID NO: 5032; or (a-xlvi) three CDRs of a heavy chain variable region set forth as SEQ ID NO: 5033 and three CDRs of a light chain variable region set forth as SEQ ID NO: 5034; or (b-xlvi) three CDRs of a heavy chain variable region set forth as SEQ ID NO: 5035 and three CDRs of a light chain variable region set forth as SEQ ID NO: 5036; or (c-xlvi) three CDRs of a heavy chain variable region set forth as SEQ ID NO: 5037 and three CDRs of a light chain variable region set forth as SEQ ID NO: 5038; or (d-xlvi) three CDRs of a heavy chain variable region set forth as SEQ ID NO: 5039 and three CDRs of a light chain variable region set forth as SEQ ID NO: 5040; or (e-xlvi) three CDRs of a heavy chain variable region set forth as SEQ ID NO: 5041 and three CDRs of a light chain variable region set forth as SEQ ID NO: 5042; or (f-xlvi) three CDRs of a heavy chain variable region set forth as SEQ ID NO: 5043 and three CDRs of a light chain variable region set forth as SEQ ID NO: 5044; or (g-xlvi) three CDRs of a heavy chain variable region set forth as SEQ ID NO: 5045 and three CDRs of a light chain variable region set forth as SEQ ID NO: 5046; or (h-xlvi) three CDRs of a heavy chain variable region set forth as SEQ ID NO: 5047 and three CDRs of a light chain variable region set forth as SEQ ID NO: 5048; or (i-xlvi) three CDRs of a heavy chain variable region set forth as SEQ ID NO: 5049 and three CDRs of a light chain variable region set forth as SEQ ID NO: 5050; or (j-xlvi) three CDRs of a heavy chain variable region set forth as SEQ ID NO: 5051 and three CDRs of a light chain variable region set forth as SEQ ID NO: 5052; or (k-xlvi) three CDRs of a heavy chain variable region set forth as SEQ ID NO: 5053 and three CDRs of a light chain variable region set forth as SEQ ID NO: 5054; or (l-xlvi) three CDRs of a heavy chain variable region set forth as SEQ ID NO: 5055 and three CDRs of a light chain variable region set forth as SEQ ID NO: 5056; or (m-xlvi) three CDRs of a heavy chain variable region set forth as SEQ ID NO: 5057 and three CDRs of a light chain variable region set forth as SEQ ID NO: 5058; or (n-xlvi) three CDRs of a heavy chain variable region set forth as SEQ ID NO: 5059 and three CDRs of a light chain variable region set forth as SEQ ID NO: 5060; or (o-xlvi) three CDRs of a heavy chain variable region set forth as SEQ ID NO: 5061 and three CDRs of a light chain variable region set forth as SEQ ID NO: 5062; or (p-xlvi) three CDRs of a heavy chain variable region set forth as SEQ ID NO: 5063 and three CDRs of a light chain variable region set forth as SEQ ID NO: 5064; or (q-xlvi) three CDRs of a heavy chain variable region set forth as SEQ ID NO: 5065 and three CDRs of a light chain variable region set forth as SEQ ID NO: 5066; or (r-xlvi) three CDRs of a heavy chain variable region set forth as SEQ ID NO: 5067 and three CDRs of a light chain variable region set forth as SEQ ID NO: 5068; or (s-xlvi) three CDRs of a heavy chain variable region set forth as SEQ ID NO: 5069 and three CDRs of a light chain variable region set forth as SEQ ID NO: 5070; or (t-xlvi) three CDRs of a heavy chain variable region set forth as SEQ ID NO: 5071 and three CDRs of a light chain variable region set forth as SEQ ID NO: 5072; or (u-xlvi) three CDRs of a heavy chain variable region set forth as SEQ ID NO: 5073 and three CDRs of a light chain variable region set forth as SEQ ID NO: 5074; or (v-xlvi) three CDRs of a heavy chain variable region set forth as SEQ ID NO: 5075 and three CDRs of a light chain variable region set forth as SEQ ID NO: 5076; or (w-xlvi) three CDRs of a heavy chain variable region set forth as SEQ ID NO: 5077 and three CDRs of a light chain variable region set forth as SEQ ID NO: 5078; or (x-xlvi) three CDRs of a heavy chain variable region set forth as SEQ ID NO: 5079 and three CDRs of a light chain variable region set forth as SEQ ID NO: 5080; or (y-xlvi) three CDRs of a heavy chain variable region set forth as SEQ ID NO: 5081 and three CDRs of a light chain variable region set forth as SEQ ID NO: 5082; or (z-xlvi) three CDRs of a heavy chain variable region set forth as SEQ ID NO: 5083 and three CDRs of a light chain variable region set forth as SEQ ID NO: 5084; or (a-xlvii) three CDRs of a heavy chain variable region set forth as SEQ ID NO: 5085 and three CDRs of a light chain variable region set forth as SEQ ID NO: 5086; or (b-xlvii) three CDRs of a heavy chain variable region set forth as SEQ ID NO: 5087 and three CDRs of a light chain variable region set forth as SEQ ID NO: 5088; or (c-xlvii) three CDRs of a heavy chain variable region set forth as SEQ ID NO: 5089 and three CDRs of a light chain variable region set forth as SEQ ID NO: 5090; or (d-xlvii) three CDRs of a heavy chain variable region set forth as SEQ ID NO: 5091 and three CDRs of a light chain variable region set forth as SEQ ID NO: 5092; or (e-xlvii) three CDRs of a heavy chain variable region set forth as SEQ ID NO: 5093 and three CDRs of a light chain variable region set forth as SEQ ID NO: 5094; or (f-xlvii) three CDRs of a heavy chain variable region set forth as SEQ ID NO: 5095 and three CDRs of a light chain variable region set forth as SEQ ID NO: 5096; or (g-xlvii) three CDRs of a heavy chain variable region set forth as SEQ ID NO: 5097 and three CDRs of a light chain variable region set forth as SEQ ID NO: 5098; or (h-xlvii) three CDRs of a heavy chain variable region set forth as SEQ ID NO: 5099 and three CDRs of a light chain variable region set forth as SEQ ID NO: 5100; or (i-xlvii) three CDRs of a heavy chain variable region set forth as SEQ ID NO: 5101 and three CDRs of a light chain variable region set forth as SEQ ID NO: 5102; or (j-xlvii) three CDRs of a heavy chain variable region set forth as SEQ ID NO: 5103 and three CDRs of a light chain variable region set forth as SEQ ID NO: 5104; or (k-xlvii) three CDRs of a heavy chain variable region set forth as SEQ ID NO: 5105 and three CDRs of a light chain variable region set forth as SEQ ID NO: 5106; or (l-xlvii) three CDRs of a heavy chain variable region set forth as SEQ ID NO: 5107 and three CDRs of a light chain variable region set forth as SEQ ID NO: 5108; or (m-xlvii) three CDRs of a heavy chain variable region set forth as SEQ ID NO: 5109 and three CDRs of a light chain variable region set forth as SEQ ID NO: 5110; or (n-xlvii) three CDRs of a heavy chain variable region set forth as SEQ ID NO: 5111 and three CDRs of a light chain variable region set forth as SEQ ID NO: 5112; or (o-xlvii) three CDRs of a heavy chain variable region set forth as SEQ ID NO: 5113 and three CDRs of a light chain variable region set forth as SEQ ID NO: 5114; or (p-xlvii) three CDRs of a heavy chain variable region set forth as SEQ ID NO: 5115 and three CDRs of a light chain variable region set forth as SEQ ID NO: 5116; or (q-xlvii) three CDRs of a heavy chain variable region set forth as SEQ ID NO: 5117 and three CDRs of a light chain variable region set forth as SEQ ID NO: 5118; or (r-xlvii) three CDRs of a heavy chain variable region set forth as SEQ ID NO: 5119 and three CDRs of a light chain variable region set forth as SEQ ID NO: 5120; or (s-xlvii) three CDRs of a heavy chain variable region set forth as SEQ ID NO: 5121 and three CDRs of a light chain variable region set forth as SEQ ID NO: 5122; or (t-xlvii) three CDRs of a heavy chain variable region set forth as SEQ ID NO: 5123 and three CDRs of a light chain variable region set forth as SEQ ID NO: 5124; or (u-xlvii) three CDRs of a heavy chain variable region set forth as SEQ ID NO: 5125 and three CDRs of a light chain variable region set forth as SEQ ID NO: 5126; or (v-xlvii) three CDRs of a heavy chain variable region set forth as SEQ ID NO: 5127 and three CDRs of a light chain variable region set forth as SEQ ID NO: 5128; or (w-xlvii) three CDRs of a heavy chain variable region set forth as SEQ ID NO: 5129 and three CDRs of a light chain variable region set forth as SEQ ID NO: 5130; or (x-xlvii) three CDRs of a heavy chain variable region set forth as SEQ ID NO: 5131 and three CDRs of a light chain variable region set forth as SEQ ID NO: 5132; or (y-xlvii) three CDRs of a heavy chain variable region set forth as SEQ ID NO: 5133 and three CDRs of a light chain variable region set forth as SEQ ID NO: 5134; or (z-xlvii) three CDRs of a heavy chain variable region set forth as SEQ ID NO: 5135 and three CDRs of a light chain variable region set forth as SEQ ID NO: 5136; or (a-xlviii) three CDRs of a heavy chain variable region set forth as SEQ ID NO: 5137 and three CDRs of a light chain variable region set forth as SEQ ID NO: 5138; or (b-xlviii) three CDRs of a heavy chain variable region set forth as SEQ ID NO: 5139 and three CDRs of a light chain variable region set forth as SEQ ID NO: 5140; or (c-xlviii) three CDRs of a heavy chain variable region set forth as SEQ ID NO: 5141 and three CDRs of a light chain variable region set forth as SEQ ID NO: 5142; or (d-xlviii) three CDRs of a heavy chain variable region set forth as SEQ ID NO: 5143 and three CDRs of a light chain variable region set forth as SEQ ID NO: 5144; or (e-xlviii) three CDRs of a heavy chain variable region set forth as SEQ ID NO: 5145 and three CDRs of a light chain variable region set forth as SEQ ID NO: 5146; or (f-xlviii) three CDRs of a heavy chain variable region set forth as SEQ ID NO: 5147 and three CDRs of a light chain variable region set forth as SEQ ID NO: 5148; or (g-xlviii) three CDRs of a heavy chain variable region set forth as SEQ ID NO: 5149 and three CDRs of a light chain variable region set forth as SEQ ID NO: 5150; or (h-xlviii) three CDRs of a heavy chain variable region set forth as SEQ ID NO: 5151 and three CDRs of a light chain variable region set forth as SEQ ID NO: 5152; or (i-xlviii) three CDRs of a heavy chain variable region set forth as SEQ ID NO: 5153 and three CDRs of a light chain variable region set forth as SEQ ID NO: 5154; or (j-xlviii) three CDRs of a heavy chain variable region set forth as SEQ ID NO: 5155 and three CDRs of a light chain variable region set forth as SEQ ID NO: 5156; or (k-xlviii) three CDRs of a heavy chain variable region set forth as SEQ ID NO: 5157 and three CDRs of a light chain variable region set forth as SEQ ID NO: 5158; or (l-xlviii) three CDRs of a heavy chain variable region set forth as SEQ ID NO: 5159 and three CDRs of a light chain variable region set forth as SEQ ID NO: 5160; or (m-xlviii) three CDRs of a heavy chain variable region set forth as SEQ ID NO: 5161 and three CDRs of a light chain variable region set forth as SEQ ID NO: 5162; or (n-xlviii) three CDRs of a heavy chain variable region set forth as SEQ ID NO: 5163 and three CDRs of a light chain variable region set forth as SEQ ID NO: 5164; or (o-xlviii) three CDRs of a heavy chain variable region set forth as SEQ ID NO: 5165 and three CDRs of a light chain variable region set forth as SEQ ID NO: 5166; or (p-xlviii) three CDRs of a heavy chain variable region set forth as SEQ ID NO: 5167 and three CDRs of a light chain variable region set forth as SEQ ID NO: 5168; or (q-xlviii) three CDRs of a heavy chain variable region set forth as SEQ ID NO: 5169 and three CDRs of a light chain variable region set forth as SEQ ID NO: 5170; or (r-xlviii) three CDRs of a heavy chain variable region set forth as SEQ ID NO: 5171 and three CDRs of a light chain variable region set forth as SEQ ID NO: 5172; or (s-xlviii) three CDRs of a heavy chain variable region set forth as SEQ ID NO: 5173 and three CDRs of a light chain variable region set forth as SEQ ID NO: 5174; or (t-xlviii) three CDRs of a heavy chain variable region set forth as SEQ ID NO: 5175 and three CDRs of a light chain variable region set forth as SEQ ID NO: 5176; or (u-xlviii) three CDRs of a heavy chain variable region set forth as SEQ ID NO: 5177 and three CDRs of a light chain variable region set forth as SEQ ID NO: 5178; or (v-xlviii) three CDRs of a heavy chain variable region set forth as SEQ ID NO: 5179 and three CDRs of a light chain variable region set forth as SEQ ID NO: 5180; or (w-xlviii) three CDRs of a heavy chain variable region set forth as SEQ ID NO: 5181 and three CDRs of a light chain variable region set forth as SEQ ID NO: 5182; or (x-xlviii) three CDRs of a heavy chain variable region set forth as SEQ ID NO: 5183 and three CDRs of a light chain variable region set forth as SEQ ID NO: 5184; or (y-xlviii) three CDRs of a heavy chain variable region set forth as SEQ ID NO: 5185 and three CDRs of a light chain variable region set forth as SEQ ID NO: 5186; or (z-xlviii) three CDRs of a heavy chain variable region set forth as SEQ ID NO: 5187 and three CDRs of a light chain variable region set forth as SEQ ID NO: 5188; or (a-xlix) three CDRs of a heavy chain variable region set forth as SEQ ID NO: 5189 and three CDRs of a light chain variable region set forth as SEQ ID NO: 5190; or (b-xlix) three CDRs of a heavy chain variable region set forth as SEQ ID NO: 5191 and three CDRs of a light chain variable region set forth as SEQ ID NO: 5192; or (c-xlix) three CDRs of a heavy chain variable region set forth as SEQ ID NO: 5193 and three CDRs of a light chain variable region set forth as SEQ ID NO: 5194; or (d-xlix) three CDRs of a heavy chain variable region set forth as SEQ ID NO: 5195 and three CDRs of a light chain variable region set forth as SEQ ID NO: 5196; or (e-xlix) three CDRs of a heavy chain variable region set forth as SEQ ID NO: 5197 and three CDRs of a light chain variable region set forth as SEQ ID NO: 5198; or (f-xlix) three CDRs of a heavy chain variable region set forth as SEQ ID NO: 5199 and three CDRs of a light chain variable region set forth as SEQ ID NO: 5200; or (g-xlix) three CDRs of a heavy chain variable region set forth as SEQ ID NO: 5201 and three CDRs of a light chain variable region set forth as SEQ ID NO: 5202; or (h-xlix) three CDRs of a heavy chain variable region set forth as SEQ ID NO: 5203 and three CDRs of a light chain variable region set forth as SEQ ID NO: 5204; or (i-xlix) three CDRs of a heavy chain variable region set forth as SEQ ID NO: 5205 and three CDRs of a light chain variable region set forth as SEQ ID NO: 5206; or (j-xlix) three CDRs of a heavy chain variable region set forth as SEQ ID NO: 5207 and three CDRs of a light chain variable region set forth as SEQ ID NO: 5208; or (k-xlix) three CDRs of a heavy chain variable region set forth as SEQ ID NO: 5209 and three CDRs of a light chain variable region set forth as SEQ ID NO: 5210; or (l-xlix) three CDRs of a heavy chain variable region set forth as SEQ ID NO: 5211 and three CDRs of a light chain variable region set forth as SEQ ID NO: 5212; or (m-xlix) three CDRs of a heavy chain variable region set forth as SEQ ID NO: 5213 and three CDRs of a light chain variable region set forth as SEQ ID NO: 5214; or (n-xlix) three CDRs of a heavy chain variable region set forth as SEQ ID NO: 5215 and three CDRs of a light chain variable region set forth as SEQ ID NO: 5216; or (o-xlix) three CDRs of a heavy chain variable region set forth as SEQ ID NO: 5217 and three CDRs of a light chain variable region set forth as SEQ ID NO: 5218; or (p-xlix) three CDRs of a heavy chain variable region set forth as SEQ ID NO: 5219 and three CDRs of a light chain variable region set forth as SEQ ID NO: 5220; or (q-xlix) three CDRs of a heavy chain variable region set forth as SEQ ID NO: 5221 and three CDRs of a light chain variable region set forth as SEQ ID NO: 5222; or (r-xlix) three CDRs of a heavy chain variable region set forth as SEQ ID NO: 5223 and three CDRs of a light chain variable region set forth as SEQ ID NO: 5224; or (s-xlix) three CDRs of a heavy chain variable region set forth as SEQ ID NO: 5225 and three CDRs of a light chain variable region set forth as SEQ ID NO: 5226; or (t-xlix) three CDRs of a heavy chain variable region set forth as SEQ ID NO: 5227 and three CDRs of a light chain variable region set forth as SEQ ID NO: 5228; or (u-xlix) three CDRs of a heavy chain variable region set forth as SEQ ID NO: 5229 and three CDRs of a light chain variable region set forth as SEQ ID NO: 5230; or (v-xlix) three CDRs of a heavy chain variable region set forth as SEQ ID NO: 5231 and three CDRs of a light chain variable region set forth as SEQ ID NO: 5232; or (w-xlix) three CDRs of a heavy chain variable region set forth as SEQ ID NO: 5233 and three CDRs of a light chain variable region set forth as SEQ ID NO: 5234; or (x-xlix) three CDRs of a heavy chain variable region set forth as SEQ ID NO: 5235 and three CDRs of a light chain variable region set forth as SEQ ID NO: 5236; or (y-xlix) three CDRs of a heavy chain variable region set forth as SEQ ID NO: 5237 and three CDRs of a light chain variable region set forth as SEQ ID NO: 5238; or (z-xlix) three CDRs of a heavy chain variable region set forth as SEQ ID NO: 5239 and three CDRs of a light chain variable region set forth as SEQ ID NO: 5240; or (a-1) three CDRs of a heavy chain variable region set forth as SEQ ID NO: 5241 and three CDRs of a light chain variable region set forth as SEQ ID NO: 5242; or (b-1) three CDRs of a heavy chain variable region set forth as SEQ ID NO: 5243 and three CDRs of a light chain variable region set forth as SEQ ID NO: 5244; or (c-1) three CDRs of a heavy chain variable region set forth as SEQ ID NO: 5245 and three CDRs of a light chain variable region set forth as SEQ ID NO: 5246; or (d-1) three CDRs of a heavy chain variable region set forth as SEQ ID NO: 5247 and three CDRs of a light chain variable region set forth as SEQ ID NO: 5248; or (e-1) three CDRs of a heavy chain variable region set forth as SEQ ID NO: 5249 and three CDRs of a light chain variable region set forth as SEQ ID NO: 5250; or (f-1) three CDRs of a heavy chain variable region set forth as SEQ ID NO: 5251 and three CDRs of a light chain variable region set forth as SEQ ID NO: 5252; or (g-1) three CDRs of a heavy chain variable region set forth as SEQ ID NO: 5253 and three CDRs of a light chain variable region set forth as SEQ ID NO: 5254; or (h-1) three CDRs of a heavy chain variable region set forth as SEQ ID NO: 5255 and three CDRs of a light chain variable region set forth as SEQ ID NO: 5256; or (i-1) three CDRs of a heavy chain variable region set forth as SEQ ID NO: 5257 and three CDRs of a light chain variable region set forth as SEQ ID NO: 5258; or (j-1) three CDRs of a heavy chain variable region set forth as SEQ ID NO: 5259 and three CDRs of a light chain variable region set forth as SEQ ID NO: 5260; or (k-1) three CDRs of a heavy chain variable region set forth as SEQ ID NO: 5261 and three CDRs of a light chain variable region set forth as SEQ ID NO: 5262; or (l-1) three CDRs of a heavy chain variable region set forth as SEQ ID NO: 5263 and three CDRs of a light chain variable region set forth as SEQ ID NO: 5264; or (m-1) three CDRs of a heavy chain variable region set forth as SEQ ID NO: 5265 and three CDRs of a light chain variable region set forth as SEQ ID NO: 5266; or (n-1) three CDRs of a heavy chain variable region set forth as SEQ ID NO: 5267 and three CDRs of a light chain variable region set forth as SEQ ID NO: 5268; or (o-1) three CDRs of a heavy chain variable region set forth as SEQ ID NO: 5269 and three CDRs of a light chain variable region set forth as SEQ ID NO: 5270; or (p-1) three CDRs of a heavy chain variable region set forth as SEQ ID NO: 5271 and three CDRs of a light chain variable region set forth as SEQ ID NO: 5272; or (q-1) three CDRs of a heavy chain variable region set forth as SEQ ID NO: 5273 and three CDRs of a light chain variable region set forth as SEQ ID NO: 5274; or (r-1) three CDRs of a heavy chain variable region set forth as SEQ ID NO: 5275 and three CDRs of a light chain variable region set forth as SEQ ID NO: 5276; or (s-1) three CDRs of a heavy chain variable region set forth as SEQ ID NO: 5277 and three CDRs of a light chain variable region set forth as SEQ ID NO: 5278; or (t-1) three CDRs of a heavy chain variable region set forth as SEQ ID NO: 5279 and three CDRs of a light chain variable region set forth as SEQ ID NO: 5280; or (u-1) three CDRs of a heavy chain variable region set forth as SEQ ID NO: 5281 and three CDRs of a light chain variable region set forth as SEQ ID NO: 5282; or (v-1) three CDRs of a heavy chain variable region set forth as SEQ ID NO: 5283 and three CDRs of a light chain variable region set forth as SEQ ID NO: 5284; or (w-1) three CDRs of a heavy chain variable region set forth as SEQ ID NO: 5285 and three CDRs of a light chain variable region set forth as SEQ ID NO: 5286; or (x-1) three CDRs of a heavy chain variable region set forth as SEQ ID NO: 5287 and three CDRs of a light chain variable region set forth as SEQ ID NO: 5288; or (y-1) three CDRs of a heavy chain variable region set forth as SEQ ID NO: 5289 and three CDRs of a light chain variable region set forth as SEQ ID NO: 5290; or (z-1) three CDRs of a heavy chain variable region set forth as SEQ ID NO: 5291 and three CDRs of a light chain variable region set forth as SEQ ID NO: 5292; or (a-li) three CDRs of a heavy chain variable region set forth as SEQ ID NO: 5293 and three CDRs of a light chain variable region set forth as SEQ ID NO: 5294; or (b-li) three CDRs of a heavy chain variable region set forth as SEQ ID NO: 5295 and three CDRs of a light chain variable region set forth as SEQ ID NO: 5296; or (c-li) three CDRs of a heavy chain variable region set forth as SEQ ID NO: 5297 and three CDRs of a light chain variable region set forth as SEQ ID NO: 5298; or (d-li) three CDRs of a heavy chain variable region set forth as SEQ ID NO: 5299 and three CDRs of a light chain variable region set forth as SEQ ID NO: 5300; or (e-li) three CDRs of a heavy chain variable region set forth as SEQ ID NO: 5301 and three CDRs of a light chain variable region set forth as SEQ ID NO: 5302; or (f-li) three CDRs of a heavy chain variable region set forth as SEQ ID NO: 5303 and three CDRs of a light chain variable region set forth as SEQ ID NO: 5304; or (g-li) three CDRs of a heavy chain variable region set forth as SEQ ID NO: 5305 and three CDRs of a light chain variable region set forth as SEQ ID NO: 5306; or (h-li) three CDRs of a heavy chain variable region set forth as SEQ ID NO: 5307 and three CDRs of a light chain variable region set forth as SEQ ID NO: 5308; or (i-li) three CDRs of a heavy chain variable region set forth as SEQ ID NO: 5309 and three CDRs of a light chain variable region set forth as SEQ ID NO: 5310; or (j-li) three CDRs of a heavy chain variable region set forth as SEQ ID NO: 5311 and three CDRs of a light chain variable region set forth as SEQ ID NO: 5312; or (k-li) three CDRs of a heavy chain variable region set forth as SEQ ID NO: 5313 and three CDRs of a light chain variable region set forth as SEQ ID NO: 5314; or (l-li) three CDRs of a heavy chain variable region set forth as SEQ ID NO: 5315 and three CDRs of a light chain variable region set forth as SEQ ID NO: 5316.

In particular embodiments, the inventions disclosed herein encompass an antibody or antigen-binding fragment thereof, wherein the antibody or fragment thereof comprises: (a) CDR-H1 comprising residues 31-35 of the heavy chain variable region (VH), CDR-H2 comprising residues 50-65 of the VH, and CDR-H3 comprising residues 95-102 of the VH; and (b) CDR-L1 comprising residues 24-34 of the light chain variable region (VL), CDR-L2 comprising residues 50-56 of the VL, and CDR-L3 comprising residues 89-97 of the VL; and wherein the CDR numbering is according to Kabat.

In particular embodiments, the inventions disclosed herein encompass an antibody or antigen-binding fragment thereof, wherein the antibody or fragment thereof comprises: (a) CDR-H1 comprising residues 26-32 of the VH, CDR-H2 comprising residues 50-58 of the VH, and CDR-H3 comprising residues 95-102 of the VH; and (b) CDR-L1 comprising residues 24-34 of the VL, CDR-L2 comprising residues 50-56 of the VL, and CDR-L3 comprising residues 89-97 of the VL; and wherein the CDR numbering is according to Chothia.

In particular embodiments, the inventions disclosed herein encompass an antibody or antigen-binding fragment thereof, wherein the antibody or fragment thereof comprises: (a) CDR-H1 comprising residues 30-35 of the VH, CDR-H2 comprising residues 47-58 of the VH, and CDR-H3 comprising residues 93-101 of the VH; and (b) CDR-L1 comprising residues 30-36 of the VL, CDR-L2 comprising residues 46-55 of the VL, and CDR-L3 comprising the residues 89-96 of the VL; and wherein the CDR numbering is according to MacCallum.

In particular embodiments, the inventions disclosed herein encompass an antibody or antigen-binding fragment thereof, wherein the antibody or fragment thereof comprises a heavy chain variable region having an amino acid sequence that is at least 60% identical (e.g., at least 70%, at least 80%, at least 85%, at least 90%, at least 95%, at least 98%, at least 99%, or 100% identical) to a heavy chain variable region sequence comprising three CDRs of the heavy chain variable region set forth in odd-numbered SEQ ID NOs 661-1320, 2751-4180, and 4749-5316 and a light chain variable region having an amino acid sequence that is at least 60% identical (e.g., at least 70%, at least 80%, at least 85%, at least 90%, at least 95%, at least 98%, at least 99%, or 100% identical) to one of the light chain variable region sequences comprising three CDRs of a corresponding light chain variable region set forth in even-numbered SEQ ID NOs 661-1320, 2751-4180, and 4749-5316.

In particular embodiments, the inventions disclosed herein encompass an antibody or antigen-binding fragment thereof, wherein the antibody or fragment thereof comprises (a) a heavy chain variable region set forth as SEQ ID NO: 4949 and a light chain variable region set forth as SEQ ID NO: 4950; or (b) a heavy chain variable region set forth as SEQ ID NO: 3275 and a light chain variable region set forth as SEQ ID NO: 3276; or (c) a heavy chain variable region set forth as SEQ ID NO: 3361 and a light chain variable region set forth as SEQ ID NO: 3362; or (d) a heavy chain variable region set forth as SEQ ID NO: 3365 and a light chain variable region set forth as SEQ ID NO: 3366; or (e) a heavy chain variable region set forth as SEQ ID NO:3421 and a light chain variable region set forth as SEQ ID NO: 3422; or (f) a heavy chain variable region set forth as SEQ ID NO: 3447 and a light chain variable region set forth as SEQ ID NO: 3448; or (g) a heavy chain variable region set forth as SEQ ID NO: 3515 and a light chain variable region set forth as SEQ ID NO: 3516; or (h) a heavy chain variable region set forth as SEQ ID NO: 3605 and a light chain variable region set forth as SEQ ID NO: 3606; or (i) a heavy chain variable region set forth as SEQ ID NO: 3647 and a light chain variable region set forth as SEQ ID NO: 3648; or (j) a heavy chain variable region set forth as SEQ ID NO: 3649 and a light chain variable region set forth as SEQ ID NO: 3650; or (k) a heavy chain variable region set forth as SEQ ID NO: 3725 and a light chain variable region set forth as SEQ ID NO: 3726; or (l) a heavy chain variable region set forth as SEQ ID NO: 3835 and a light chain variable region set forth as SEQ ID NO: 3836; or (m) a heavy chain variable region set forth as SEQ ID NO: 3845 and a light chain variable region set forth as SEQ ID NO: 3846; or (n) a heavy chain variable region set forth as SEQ ID NO: 3853 and a light chain variable region set forth as SEQ ID NO: 3854; or (o) a heavy chain variable region set forth as SEQ ID NO: 3873 and a light chain variable region set forth as SEQ ID NO: 3874; or (p) a heavy chain variable region set forth as SEQ ID NO: 5029 and a light chain variable region set forth as SEQ ID NO: 5030; or (q) a heavy chain variable region set forth as SEQ ID NO: 5131 and a light chain variable region set forth as SEQ ID NO: 5132; or (r) a heavy chain variable region set forth as SEQ ID NO: 5217 and a light chain variable region set forth as SEQ ID NO: 5218; or (s) a heavy chain variable region set forth as SEQ ID NO: 5311 and a light chain variable region set forth as SEQ ID NO: 5312.

In particular embodiments, the inventions disclosed herein encompass an antibody comprising: (a) a heavy chain comprising SEQ ID NO: 5735 and a light chain comprising SEQ ID NO: 5736; or (b) a heavy chain comprising SEQ ID NO: 5707 and a light chain comprising SEQ ID NO: 5708; or (c) a heavy chain comprising SEQ ID NO: 5709 and a light chain comprising SEQ ID NO: 5710; or (d) a heavy chain comprising SEQ ID NO: 5711 and a light chain comprising SEQ ID NO: 5712; or (e) a heavy chain comprising SEQ ID NO: 5713 and a light chain comprising SEQ ID NO: 5714; or (f) a heavy chain comprising SEQ ID NO: 5715 and a light chain comprising SEQ ID NO: 5716; or (g) a heavy chain comprising SEQ ID NO: 5717 and a light chain comprising SEQ ID NO: 5718; or (h) a heavy chain comprising SEQ ID NO: 5719 and a light chain comprising SEQ ID NO: 5720; or (i) a heavy chain comprising SEQ ID NO: 5721 and a light chain comprising SEQ ID NO: 5722; or (j) a heavy chain comprising SEQ ID NO: 5723 and a light chain comprising SEQ ID NO: 5724; or (k) a heavy chain comprising SEQ ID NO: 5725 and a light chain comprising SEQ ID NO: 5726; or (l) a heavy chain comprising SEQ ID NO: 5727 and a light chain comprising SEQ ID NO: 5728; or (m) a heavy chain comprising SEQ ID NO: 5729 and a light chain comprising SEQ ID NO: 5730; or (n) a heavy chain comprising SEQ ID NO: 5731 and a light chain comprising SEQ ID NO: 5732; or (o) a heavy chain comprising SEQ ID NO: 5733 and a light chain comprising SEQ ID NO: 5734; or (p) a heavy chain comprising SEQ ID NO: 5737 and a light chain comprising SEQ ID NO: 5738; or (q) a heavy chain comprising SEQ ID NO: 5739 and a light chain comprising SEQ ID NO: 5740; or (r) a heavy chain comprising SEQ ID NO: 5741 and a light chain comprising SEQ ID NO: 5742; or (s) a heavy chain comprising SEQ ID NO: 5743 and a light chain comprising SEQ ID NO: 5744.

In particular embodiments, the inventions disclosed herein encompass an antibody or antigen-binding fragment thereof, wherein the antibody or fragment thereof comprises a heavy chain variable region having an amino acid sequence that is identical to the heavy chain variable region set forth in odd-numbered SEQ ID NOs 661-1320, 2751-4180, and 4749-5316 and a light chain variable region having an amino acid sequence that is identical to the light chain variable region set forth in even-numbered SEQ ID NOs 661-1320, 2751-4180, and 4749-5316.

In particular embodiments, the inventions disclosed herein encompass an antibody or antigen-binding fragment thereof described in the preceding paragraphs of this section that specifically binds to a SARS-CoV Spike protein.

In particular embodiments, the inventions disclosed herein encompass an antibody or antigen-binding fragment thereof described in the preceding paragraphs of this section that specifically binds to a SARS-CoV-2 Spike protein.

In particular embodiments, the inventions disclosed herein encompass an antibody or antigen-binding fragment thereof described in the preceding paragraphs of this section that is cross-reactive with the SARS-CoV Spike protein and SARS-CoV-2 Spike protein.

In particular embodiments, the inventions disclosed herein encompass an antibody or antigen-binding fragment thereof described in the preceding paragraphs of this section that is a neutralizing antibody.

In particular embodiments, the inventions disclosed herein encompass an antibody or antigen-binding fragment thereof described in the preceding paragraphs of this section that is a depleting antibody.

In particular embodiments, the inventions disclosed herein encompass an antibody or antigen-binding fragment thereof described in the preceding paragraphs of this section that binds an epitope comprising one or more of the following residues of the SARS-CoV-2 Spike protein: Y351, Y449, N450, L452, L455, F456, T470, I472, N481, G482, V483, E484, G485, F486, Y489, F490, L492, Q493, S494, wherein the amino acid residue positions correspond to SEQ ID NO: 5317. In particular embodiments, the epitope comprises two or more of the listed residues, three or more of the listed residues, or five or more of the listed residues.

In particular embodiments, the inventions disclosed herein encompass an antibody or antigen-binding fragment thereof described in the preceding paragraphs of this section that binds an epitope comprising one or more of the following residues of the SARS-CoV-2 Spike protein: R403, D405, R408, Q409, T415, G416, K417, D420, Y421, Y453, L455, F456, R457, K458, S459, N460, Y473, Q474, A475, G476, F486, N487, Y489, Q493, S494, Y495, G496, Q498, T500, N501, G502, Y505, wherein the amino acid residue positions correspond to SEQ ID NO: 5317. In particular embodiments, the epitope comprises two or more of the listed residues, three or more of the listed residues, or five or more of the listed residues.

In particular embodiments, the inventions disclosed herein encompass an antibody or antigen-binding fragment thereof described in the preceding paragraphs of this section that binds the SARS-CoV-2 Spike protein, wherein the antibody binds an epitope comprising one or more of the following residues of SARS-CoV-2 Spike protein: R403, T415, G416, K417, D420, Y421, L455, F456, R457, K458, S459, N460, Y473, Q474, A475, G476, S477, F486, N487, Y489, N501, G502, Y505, wherein the amino acid residue positions correspond to SEQ ID NO: 5317. In particular embodiments, the epitope comprises two or more of the listed residues, three or more of the listed residues, or five or more of the listed residues.

In particular embodiments, the inventions disclosed herein encompass an antibody or antigen-binding fragment thereof described in the preceding paragraphs of this section that has an IgG1 isotype.

In particular embodiments, the inventions disclosed herein encompass an antibody or antigen-binding fragment thereof described in the preceding paragraphs of this section that comprises an Fc region comprising N-glycoside-linked sugar chains bound to the Fc region, wherein the sugar chains do not contain fucose.

In particular embodiments, the inventions disclosed herein encompass an antibody or antigen-binding fragment thereof described in the preceding paragraphs of this section that comprises at least one amino acid substitution. In particular embodiments, the at least one amino acid substitution is a conservative substitution. In particular embodiments, the at least one amino acid substitution is a substitution of an amino acid for a non-genetically encoded amino acid or a synthetic amino acid.

In particular embodiments, the inventions disclosed herein encompass an antibody or antigen-binding fragment thereof described in the preceding paragraphs of this section that is conjugated to an immunomodulator, a cytokine, a cytotoxic agent, a chemotherapeutic agent, a diagnostic agent, an antiviral agent, an antimicrobial agent, or a drug.

In particular embodiments, the inventions disclosed herein encompass an antibody conjugate comprising an antibody or antigen-binding fragment thereof described in the preceding paragraphs of this section that is conjugated to an immunomodulator, a cytokine, a cytotoxic agent, a chemotherapeutic agent, a diagnostic agent, an antiviral agent, an antimicrobial agent, or a drug.

In particular embodiments, the inventions disclosed herein encompass a pharmaceutical composition comprising an antibody or antigen-binding fragment thereof described in the preceding paragraphs of this section or an antibody conjugate comprising the same, and one or more pharmaceutically acceptable carriers, diluents, or excipients. In particular embodiments, the pharmaceutical composition comprises at least one additional antibody that binds the SARS-CoV-2 Spike protein. In particular embodiments, the pharmaceutical composition comprises histidine, sodium chloride, sucrose, and polysorbate 80. In particular embodiments, the pharmaceutical composition has a pH of about 6.0. In particular embodiments, the pharmaceutical composition comprises 5 mM histidine, 50 mM NaCl, 6% sucrose, and 0.05% polysorbate 80 and has a pH of about 6.0.

In particular embodiments, the concentration of the antibody or antigen-binding fragment thereof described in the preceding paragraphs of this section that is in the pharmaceutical composition is about 35 mg/mL to about 125 mg/mL. In particular embodiments, the concentration of the antibody or antigen-binding fragment thereof in the pharmaceutical composition is about 35 mg/mL or about 125 mg/mL.

In particular embodiments, the inventions disclosed herein encompass an isolated nucleic acid encoding a heavy chain variable region having an amino acid sequence that is identical to the heavy chain variable region set forth in odd-numbered SEQ ID NOs 661-1320, 2751-4180, and 4749-5316. In particular embodiments, the inventions disclosed herein encompass an isolated nucleic acid encoding a light chain variable region having an amino acid sequence that is identical to the light chain variable region set forth in even-numbered SEQ ID NOs 661-1320, 2751-4180, and 4749-5316. In particular embodiments, the inventions disclosed herein encompass an isolated nucleic acid encoding a heavy chain having an amino acid sequence that is identical to the heavy chain set forth in odd-numbered SEQ ID NOs 5319-5366, 5575-5592, and 5707-5744. In particular embodiments, the inventions disclosed herein encompass an isolated nucleic acid encoding a light chain having an amino acid sequence that is identical to the light chain set forth in even-numbered SEQ ID NOs 5319-5366, 5575-5592, and 5707-5744.

In particular embodiments, the inventions disclosed herein encompass a vector comprising at least one of (a) an isolated nucleic acid encoding a heavy chain variable region having an amino acid sequence that is identical to the heavy chain variable region set forth in odd-numbered SEQ ID NOs 661-1320, 2751-4180, and 4749-5316; and (b) an isolated nucleic acid encoding a light chain variable region having an amino acid sequence that is identical to the light chain variable region set forth in even-numbered SEQ ID NOs 661-1320, 2751-4180, and 4749-5316. In particular embodiments, the inventions disclosed herein encompass a vector comprising at least one of (a) an isolated nucleic acid encoding a heavy chain having an amino acid sequence that is identical to the heavy chain set forth in odd-numbered SEQ ID NOs 5319-5366, 5575-5592, and 5707-5744; and (b) an isolated nucleic acid encoding a light chain having an amino acid sequence that is identical to the light chain set forth in even-numbered SEQ ID NOs 5319-5366, 5575-5592, and 5707-5744.

In particular embodiments, the inventions disclosed herein encompass a host cell comprising at least one of (a) an isolated nucleic acid encoding a heavy chain variable region having an amino acid sequence that is identical to the heavy chain variable region set forth in odd-numbered SEQ ID NOs 661-1320, 2751-4180, and 4749-5316; and (b) an isolated nucleic acid encoding a light chain variable region having an amino acid sequence that is identical to the light chain variable region set forth in even-numbered SEQ ID NOs 661-1320, 2751-4180, and 4749-5316. In particular embodiments, the inventions disclosed herein encompass a host cell comprising at least one of (a) an isolated nucleic acid encoding a heavy chain having an amino acid sequence that is identical to the heavy chain set forth in odd-numbered SEQ ID NOs 5319-5366, 5575-5592, and 5707-5744; and (b) an isolated nucleic acid encoding a light chain having an amino acid sequence that is identical to the light chain set forth in even-numbered SEQ ID NOs 5319-5366, 5575-5592, and 5707-5744.

In particular embodiments, the inventions disclosed herein encompass a host cell comprising a vector comprising at least one of (a) an isolated nucleic acid encoding a heavy chain variable region having an amino acid sequence that is identical to the heavy chain variable region set forth in odd-numbered SEQ ID NOs 661-1320, 2751-4180, and 4749-5316; and (b) an isolated nucleic acid encoding a light chain variable region having an amino acid sequence that is identical to the light chain variable region set forth in even-numbered SEQ ID NOs 661-1320, 2751-4180, and 4749-5316. In particular embodiments, the inventions disclosed herein encompass a host cell comprising a vector comprising at least one of (a) an isolated nucleic acid encoding a heavy chain having an amino acid sequence that is identical to the heavy chain set forth in odd-numbered SEQ ID NOs 5319-5366, 5575-5592, and 5707-5744; and (b) an isolated nucleic acid encoding a light chain having an amino acid sequence that is identical to the light chain set forth in even-numbered SEQ ID NOs 5319-5366, 5575-5592, and 5707-5744.

In particular embodiments, the inventions disclosed herein encompass a process for producing an antibody or antigen-binding fragment thereof described in the preceding paragraphs of this section comprising (a) cultivating the host cell described in the preceding paragraphs under conditions such that the antibody or antigen-binding fragment thereof is expressed; and (b) recovering the expressed antibody or antigen-binding fragment thereof.

In particular embodiments, the inventions disclosed herein encompass an article of manufacture useful for diagnosing or treating a SARS-CoV or SARS-CoV-2-linked disease comprising a receptacle comprising the antibody or antigen-binding fragment thereof described in the preceding paragraphs of this section, or an antibody conjugate comprising the same, or a pharmaceutical composition comprising the same and instructional materials for using the same to treat or diagnose the SARS-CoV or SARS-CoV-2-linked disease.

In particular embodiments, the inventions disclosed herein encompass a method of identifying a SARS-CoV or SARS-CoV-2-infected cell comprising: (a) contacting a cell with an antibody or antigen-binding fragment thereof described in the preceding paragraphs of this section, which is conjugated to a detectable agent; and (b) detecting specific binding of the antibody or antigen-binding fragment thereof to the cell.

In particular embodiments, the inventions disclosed herein encompass a method of diagnosing a SARS-CoV or SARS-CoV-2 infection in a patient comprising: (a) contacting a sample obtained from a patient with the antibody or antigen-binding fragment thereof described in the preceding paragraphs of this section, which is conjugated to a detectable agent; and (b) detecting specific binding of the antibody or antigen-binding fragment thereof to a SARS-CoV or SARS-CoV-2 antigen present in the sample.

In particular embodiments, the inventions disclosed herein encompass a method of treating or preventing a SARS-CoV or SARS-CoV-2-linked disease comprising administering to a patient a therapeutically effective amount of the antibody or antigen-binding fragment thereof described in the preceding paragraphs of this section, or an antibody conjugate comprising the same, or a pharmaceutical composition comprising the same.

In particular embodiments, the inventions disclosed herein encompass a method of preventing or treating COVID-19 comprising: (a) contacting a sample obtained from a patient with an antibody or antigen-binding fragment thereof described in the preceding paragraphs of this section, which is conjugated to a detectable agent; (b) detecting specific binding of the antibody or antigen-binding fragment thereof to a SARS-CoV-2 antigen present in the sample; and (c) administering to the patient a therapeutically effective amount of the an antibody or antigen-binding fragment thereof described in the preceding paragraphs of this section or a pharmaceutical composition comprising the same.

In particular embodiments, the inventions disclosed herein encompass methods of prophylaxis and therapy described in this section wherein the antibody or antigen-binding fragment thereof is administered or administrable to the patient intravenously or subcutaneously at about 700 mg to about 7000 mg. In particular embodiments, the antibody is administered to the patient intravenously or subcutaneously at about 700 mg. In some embodiments, in methods of prophylaxis and therapy described in this section, the antibody or antigen-binding fragment thereof is administered or administrable to the patient intravenously or subcutaneously at about 35 mg to about 700 mg.

In particular embodiments, the inventions disclosed herein encompass methods of prophylaxis and therapy described in this section wherein the method further comprises administering to the patient another antibody or antigen-binding fragment thereof that binds the SARS-CoV-2 S protein.

In particular embodiments, the inventions disclosed herein encompass methods of prophylaxis and therapy described in this section wherein the patient has mild to moderate COVID-19. In particular embodiments, the inventions disclosed herein encompass methods of prophylaxis and therapy described in this section wherein the patient is at risk for contracting COVID-19. In particular embodiments, the inventions disclosed herein encompass methods of prophylaxis and therapy described in this section wherein the patient is at high risk for progressing to severe COVID-19 or hospitalization.

In particular embodiments, the inventions disclosed herein encompass an antibody or antigen-binding fragment thereof described in the preceding paragraphs of this section or a pharmaceutical composition comprising the same for use in the diagnosis, theragnosis, treatment and/or prophylaxis of a SARS-CoV or SARS-CoV-2-related disease or symptom.

In particular embodiments, the inventions disclosed herein encompass an antibody or antigen-binding fragment thereof described in the preceding paragraphs of this section or a pharmaceutical composition comprising the same for use in the manufacture of a medicament for diagnosis, theragnosis, treatment and/or prophylaxis of a SARS-CoV or SARS-CoV-2-related disease or symptom.

In particular embodiments, the inventions disclosed herein encompass a method of testing an anti-coronavirus vaccine, comprising (a) contacting a sample of an anti-coronavirus vaccine with an antibody or antigen-binding fragment thereof described in the preceding paragraphs of this section, conjugated to a detectable agent; and (b) detecting specific binding of the antibody or antigen-binding fragment thereof to the anti-coronavirus vaccine present in the sample; wherein the anti-coronavirus vaccine comprises a coronavirus subunit or fragment thereof.

Anti-coronavirus Antibodies (e.g., Anti-SARS-CoV-2 Antibodies)

The present disclosure is directed to anti-coronavirus antibodies (e.g., anti-SARS-CoV-2 antibodies) and their use in the diagnosis, theragnosis, treatment and/or prophylaxis of SARS-CoV and SARS-CoV-2 infections and related symptoms (i.e., SARS and COVID-19 coronavirus disease). As used herein, the term "anti-coronavirus antibody(ies)" describes antibodies that specifically recognize, bind to, or otherwise associate with one or more antigens present on the SARS-CoV and/or SARS-CoV-2 Spike protein (i.e., antibodies that are specific for one or the other protein or that are cross-reactive are encompassed). Anti-coronavirus antibodies (e.g., anti-SARS-CoV-2 antibodies) disclosed herein may be used alone or in conjunction with a wide variety of other compounds or biological response modifiers. In other selected embodiments, two or more discrete anti-coronavirus antibodies (e.g., anti-SARS-CoV-2 antibodies) may be used in combination to provide enhanced therapeutic effects or may be used to fabricate multispecific constructs. Accordingly, provided are also compositions comprising two, three, or more discrete anti-coronavirus antibodies. The anti-coronavirus antibodies (e.g., anti-SARS-CoV-2 antibodies) herein are recombinant in nature.

Provided herein are antibodies or antigen-binding fragments thereof that specifically bind to a SARS-CoV-2 antigen, SARS-CoV-2 viral particle, or SARS-CoV-2-infected cell ("anti-SARS-CoV-2 antibodies or antigen binding fragments"). In some embodiments, the anti-SARS-CoV-2 antibodies or antigen binding fragments specifically bind the Spike (S) protein of SARS-CoV-2. The terms "bind" and "binds" as used herein are intended to mean, unless indicated otherwise, the ability of a protein or molecule to form a chemical bond or attractive interaction with another protein or molecule, which results in proximity of the two proteins or molecules as determined by common methods known in the art.

The cryo-electron microscopy structure of the SARS-CoV-2 S protein has been described recently, and shows the SARS-CoV-2 S protein is a trimeric class I fusion protein that exists in a metastable pre-fusion conformation and undergoes a substantial structural rearrangement to fuse the viral membrane with the host cell membrane (Wrapp et al., *Science* 367, 1260-1263, 2020). This process is triggered when the receptor-binding domain (RBD) of the 51 subunit of the SARS-CoV-2 S protein binds to the host cell receptor angiotensin-converting enzyme 2 (ACE2); and receptor binding destabilizes the pre-fusion trimer, resulting in shedding of the 51 subunit and transition of the S2 subunit to a stable post-fusion conformation (Wrapp et al., *Science* 367, 1260-1263, 2020).

The amino acid sequence of SARS-CoV-2 Spike (S) protein has been described before, for example, GenBank Accession No: YP_009724390.1 provides such an exemplary sequence, as shown below:

(SEQ ID NO: 5317)
MFVFLVLLPLVSSQCVNLTTRTQLPPAYTNSFTRGVYYPDKVFRSSVLHSTQDLFLPFFSNVTWFH

AIHVSGTNGTKRFDNPVLPFNDGVYFASTEKSNIIRGWIFGTTLDSKTQSLLIVNNATNVVIKVCEF

QFCNDPFLGVYYHKNNKSWMESEFRVYSSANNCTFEYVSQPFLMDLEGKQGNFKNLREFVFKNI

DGYFKIYSKHTPINLVRDLPQGFSALEPLVDLPIGINITRFQTLLALHRSYLTPGDSSSGWTAGAAA

YYVGYLQPRTFLLKYNENGTITDAVDCALDPLSETKCTLKSFTVEKGIYQTSNFRVQPTESIVRFPN

ITNLCPFGEVFNATRFASVYAWNRKRISNCVADYSVLYNSASFSTFKCYGVSPTKLNDLCFTNVYA

DSFVIRGDEVRQIAPGQTGKIADYNYKLPDDFTGCVIAWNSNNLDSKVGGNYNYLYRLFRKSNLK

PFERDISTEIYQAGSTPCNGVEGFNCYFPLQSYGFQPTNGVGYQPYRVVVLSFELLHAPATVCGPK

KSTNLVKNKCVNFNFNGLTGTGVLTESNKKFLPFQQFGRDIADTTDAVRDPQTLEILDITPCSFGG

VSVITPGTNTSNQVAVLYQDVNCTEVPVAIHADQLTPTWRVYSTGSNVFQTRAGCLIGAEHVNNS

YECDIPIGAGICASYQTQTNSPRRARSVASQSIIAYTMSLGAENSVAYSNNSIAIPTNFTISVTTEILPV

SMTKTSVDCTMYICGDSTECSNLLLQYGSFCTQLNRALTGIAVEQDKNTQEVFAQVKQIYKTPPIK

DFGGFNFSQILPDPSKPSKRSFIEDLLFNKVTLADAGFIKQYGDCLGDIAARDLICAQKFNGLTVLPP

LLTDEMIAQYTSALLAGTITSGWTFGAGAALQIPFAMQMAYRFNGIGVTQNVLYENQKLIANQFN

SAIGKIQDSLSSTASALGKLQDVVNQNAQALNTLVKQLSSNFGAISSVLNDILSRLDKVEAEVQIDR

LITGRLQSLQTYVTQQLIRAAEIRASANLAATKMSECVLGQSKRVDFCGKGYHLMSFPQSAPHGV

VFLHVTYVPAQEKNFTTAPAICHDGKAHFPREGVFVSNGTHWFVTQRNFYEPQIITTDNTFVSGNC

DVVIGIVNNTVYDPLQPELDSFKEELDKYFKNHTSPDVDLGDISGINASVVNIQKEIDRLNEVAKNL

NESLIDLQELGKYEQYIKWPWYIWLGFIAGLIAIVMVTIMLCCMTSCCSCLKGCCSCGSCCKFDED

DSEPVLKGVKLHYT.

The receptor-binding domain (RBD) comprises amino acids 329 to 520 of the SARS-CoV-2 S protein, e.g., amino acids 329 to 520 of SEQ ID NO: 5317, or a variant comprising one or more mutations; the N-terminal domain (NTD) comprises amino acids 16-328 of the SARS-CoV-2 S protein, e.g., amino acids 16-328 of SEQ ID NO: 5317, or a variant comprising one or more mutations; S2 domain comprises amino acids 686-1213 of the SARS-CoV-2 S protein, e.g., amino acids 686-1213 of SEQ ID NO: 5317, or a variant comprising one or more mutations (see Wrapp et al., *Science* 367, 1260-1263, 2020).

The amino acid sequence of SARS-CoV Spike protein has also been described before, for example, UniProt ID: P59594, as shown below:

(SEQ ID NO: 5318)
MFIFLLFLTLTSGSDLDRCTTFDDVQAPNYTQHTSSMRGVYYPDEIFRSDTLYLTQDLFLPFYSNVT

GFHTINHTFGNPVIPFKDGIYFAATEKSNVVRGWVFGSTMNNKSQSVIIINNSTNVVIRACNFELCD

NPFFAVSKPMGTQTHTMIFDNAFNCTFEYISDAFSLDVSEKSGNFKHLREFVFKNKDGFLYVYKGY

QPIDVVRDLPSGFNTLKPIFKLPLGINITNFRAILTAFSPAQDIWGTSAAAYFVGYLKPTTFMLKYDE

NGTITDAVDCSQNPLAELKCSVKSFEIDKGIYQTSNFRVVPSGDVVRFPNITNLCPFGEVFNATKFP

SVYAWERKKISNCVADYSVLYNSTFFSTFKCYGVSATKLNDLCFSNVYADSFVVKGDDVRQIAPG

QTGVIADYNYKLPDDFMGCVLAWNTRNIDATSTGNYNYKYRYLRHGKLRPFERDISNVPFSPDGK

PCTPPALNCYWPLNDYGFYTTTGIGYQPYRVVVLSFELLNAPATVCGPKLSTDLIKNQCVNFNFNG

LTGTGVLTPSSKRFQPFQQFGRDVSDFTDSVRDPKTSEILDISPCSFGGVSVITPGTNASSEVAVLYQ

DVNCTDVSTAIHADQLTPAWRIYSTGNNVFQTQAGCLIGAEHVDTSYECDIPIGAGICASYHTVSL

LRSTSQKSIVAYTMSLGADSSIAYSNNTIAIPTNFSISITTEVMPVSMAKTSVDCNMYICGDSTECAN

LLLQYGSFCTQLNRALSGIAAEQDRNTREVFAQVKQMYKTPTLKYFGGFNFSQILPDPLKPTKRSFI

EDLLFNKVTLADAGFMKQYGECLGDINARDLICAQKFNGLTVLPPLLTDDMIAAYTAALVSGTAT

AGWTFGAGAALQIPFAMQMAYRFNGIGVTQNVLYENQKQIANQFNKAISQIQESLTTTSTALGKL

```
QDVVNQNAQALNTLVKQLSSNFGAISSVLNDILSRLDKVEAEVQIDRLITGRLQSLQTYVTQQLIR

AAEIRASANLAATKMSECVLGQSKRVDFCGKGYHLMSFPQAAPHGVVFLHVTYVPSQERNFTTA

PAICHEGKAYFPREGVFVFNGTSWFITQRNFFSPQIITTDNTFVSGNCDVVIGIINNTVYDPLQPELD

SFKEELDKYFKNHTSPDVDLGDISGINASVVNIQKEIDRLNEVAKNLNESLIDLQELGKYEQYIKWP

WYVWLGFIAGLIAIVMVTILLCCMTSCCSCLKGACSCGSCCKFDEDDSEPVLKGVKLHYT.
```

In some embodiments, provided herein are anti-SARS-CoV-2 antibodies having internal designations 258 to 577 and 589 to 1587 as described herein. In some embodiments, provided herein are anti-SARS-CoV-2 antibodies or antigen binding fragments that comprise the VH and/or the VL of any one of antibodies 258 to 577 and 589 to 1587. In some embodiments, provided herein are anti-SARS-CoV-2 antibodies or antigen binding fragments that comprise a VH domain having at least 80%, at least 85%, at least 90%, at least 95%, at least 98%, at least 99%, or 100% identity to the VH domain of any one of antibodies 258 to 577 and 589 to 1587, or a VL domain having at least 80%, at least 85%, at least 90%, at least 95%, at least 98%, at least 99%, or 100% identity to the VH domain of any one of antibodies 258 to 577 and 589 to 1587. In some embodiments, provided herein are anti-SARS-CoV-2 antibodies or antigen binding fragments that comprise a VH domain having at least 80%, at least 85%, at least 90%, at least 95%, at least 98%, at least 99%, or 100% identity to the VH domain of any one of antibodies 258 to 577 and 589 to 1587, and a VL domain having at least 80%, at least 85%, at least 90%, at least 95%, at least 98%, at least 99%, or 100% identity to the VH domain of any one of antibodies 258 to 577 and 589 to 1587, preferably wherein these homologous VH and VL domains correspond to those of the same antibody.

In some embodiments, provided herein are anti-SARS-CoV-2 antibodies or antigen binding fragments that comprise a VH domain comprising the same three CDRs as comprised in the VH domain of any one of antibodies 258 to 577 and 589 to 1587 and/or comprises a VL domain comprising the same three CDRs as the VL domain of any one of antibodies 258 to 577 and 589 to 1587, wherein the CDRs are defined by Kabat, Chothia, MacCallum or North numbering.

In some embodiments, the anti-SARS-CoV-2 antibodies or antigen binding fragments provided herein are neutralizing antibodies. In particular embodiments, neutralizing anti-SARS-CoV-2 antibodies or antigen binding fragments comprise: (a) three CDRs in the heavy chain variable region (VH) set forth as SEQ ID NO: 729 and three CDRs in the light chain variable region (VL) set forth as SEQ ID NO: 730; (b) three CDRs in the VH set forth as SEQ ID NO: 763 and three CDRs in the VL set forth as SEQ ID NO: 764; (c) three CDRs in the VH set forth as SEQ ID NO: 873 and three CDRs in the VL set forth as SEQ ID NO: 874; (d) three CDRs in the VH set forth as SEQ ID NO: 891 and three CDRs in the VL set forth as SEQ ID NO: 892; (e) three CDRs in the VH set forth as SEQ ID NO: 921 and three CDRs in the VL set forth as SEQ ID NO: 922; (f) three CDRs in the VH set forth as SEQ ID NO: 961 and three CDRs in the VL set forth as SEQ ID NO: 962; (g) three CDRs in the VH set forth as SEQ ID NO: 973 and three CDRs in the VL set forth as SEQ ID NO: 974; (h) three CDRs in the VH set forth as SEQ ID NO: 979 and three CDRs in the VL set forth as SEQ ID NO: 980; (i) three CDRs in the VH set forth as SEQ ID NO: 983 and three CDRs in the VL set forth as SEQ ID NO: 984; (j) three CDRs in the VH set forth as SEQ ID NO: 1029 and three CDRs in the VL set forth as SEQ ID NO: 1030; (k) three CDRs in the VH set forth as SEQ ID NO: 1035 and three CDRs in the VL set forth as SEQ ID NO: 1036; (l) three CDRs in the VH set forth as SEQ ID NO: 1039 and three CDRs in the VL set forth as SEQ ID NO: 1040; (m) three CDRs in the VH set forth as SEQ ID NO: 1069 and three CDRs in the VL set forth as SEQ ID NO: 1070; (n) three CDRs in the VH set forth as SEQ ID NO: 1103 and three CDRs in the VL set forth as SEQ ID NO: 1104; (o) three CDRs in the VH set forth as SEQ ID NO: 1107 and three CDRs in the VL set forth as SEQ ID NO: 1108; (p) three CDRs in the VH set forth as SEQ ID NO: 1111 and three CDRs in the VL set forth as SEQ ID NO: 1112; (q) three CDRs in the VH set forth as SEQ ID NO: 1121 and three CDRs in the VL set forth as SEQ ID NO: 1122; (r) three CDRs in the VH set forth as SEQ ID NO: 1133 and three CDRs in the VL set forth as SEQ ID NO: 1134; (s) three CDRs in the VH set forth as SEQ ID NO: 1157 and three CDRs in the VL set forth as SEQ ID NO: 1158; (t) three CDRs in the VH set forth as SEQ ID NO: 1225 and three CDRs in the VL set forth as SEQ ID NO: 1226; (u) three CDRs in the VH set forth as SEQ ID NO: 1243 and three CDRs in the VL set forth as SEQ ID NO: 1244; (v) three CDRs in the VH set forth as SEQ ID NO: 1251 and three CDRs in the VL set forth as SEQ ID NO: 1252; (w) three CDRs in the VH set forth as SEQ ID NO: 1255 and three CDRs in the VL set forth as SEQ ID NO: 1256; (x) three CDRs in the VH set forth as SEQ ID NO: 1269 and three CDRs in the VL set forth as SEQ ID NO: 1270; (y) three CDRs in the VH set forth as SEQ ID NO: 3275 and three CDRs in the VL set forth as SEQ ID NO: 3276; (z) three CDRs in the VH set forth as SEQ ID NO: 3361 and three CDRs in the VL set forth as SEQ ID NO: 3362; (aa) three CDRs in the VH set forth as SEQ ID NO: 3365 and three CDRs in the VL set forth as SEQ ID NO: 3366; (bb) three CDRs in the VH set forth as SEQ ID NO: 3421 and three CDRs in the VL set forth as SEQ ID NO: 3422; (cc) three CDRs in the VH set forth as SEQ ID NO: 3447 and three CDRs in the VL set forth as SEQ ID NO: 3448; (dd) three CDRs in the VH set forth as SEQ ID NO: 3515 and three CDRs in the VL set forth as SEQ ID NO: 3516; (ee) three CDRs in the VH set forth as SEQ ID NO: 3605 and three CDRs in the VL set forth as SEQ ID NO: 3606; (ff) three CDRs in the VH set forth as SEQ ID NO: 3647 and three CDRs in the VL set forth as SEQ ID NO: 3648; (gg) three CDRs in the VH set forth as SEQ ID NO: 3649 and three CDRs in the VL set forth as SEQ ID NO: 3650; (hh) three CDRs in the VH set forth as SEQ ID NO: 3725 and three CDRs in the VL set forth as SEQ ID NO: 3726; (ii) three CDRs in the VH set forth as SEQ ID NO: 3835 and three CDRs in the VL set forth as SEQ ID NO: 3836; (jj) three CDRs in the VH set forth as SEQ ID NO: 3845 and three CDRs in the VL set forth as SEQ ID NO: 3846; (kk) three CDRs in the VH set forth as SEQ ID NO: 3853 and three CDRs in the VL set forth as SEQ ID NO: 3854; (ll) three CDRs in the VH set forth as SEQ ID NO: 3873 and three CDRs in the VL set forth as SEQ ID NO: 3874; (mm) three CDRs in the VH set forth as SEQ ID NO: 4949 and three CDRs in the VL set forth as SEQ ID NO: 4950; (nn) three CDRs in the VH set forth as SEQ ID NO: 5029 and three CDRs in the VL set forth as SEQ ID NO: 5030; (oo) three CDRs in the VH set forth as SEQ ID NO: 5131 and three CDRs in the VL set forth as SEQ ID NO: 5132; (pp) three CDRs in the VH set forth as SEQ ID NO: 5217 and three CDRs in the VL set forth as SEQ ID NO: 5218; or (qq) three CDRs in the VH set forth as SEQ ID NO: 5311 and three CDRs in the VL set forth as SEQ ID NO: 5312, wherein the CDRs are defined by Kabat, Chothia, MacCallum, or North numbering.

In other embodiments, neutralizing anti-SARS-CoV-2 antibodies or antigen binding fragments comprise: (a) the VH set forth as SEQ ID NO: 729 and the light chain variable region VL set forth as SEQ ID NO: 730; (b) the VH set forth as SEQ ID NO: 763 and the VL set forth as SEQ ID NO: 764; (c) the VH set forth as SEQ ID NO: 873 and the VL set forth as SEQ ID NO: 874; (d) the VH set forth as SEQ ID NO: 891 and the VL set forth as SEQ ID NO: 892; (e) the VH set forth as SEQ ID NO: 921 and the VL set forth as SEQ ID NO: 922; (f) the VH set forth as SEQ ID NO: 961 and the VL set forth as SEQ ID NO: 962; (g) the VH set forth as SEQ ID NO: 973 and the VL set forth as SEQ ID NO: 974; (h) the VH set forth as SEQ ID NO: 979 and the VL set forth as SEQ ID NO: 980; (i) the VH set forth as SEQ ID NO: 983 and the VL set forth as SEQ ID NO: 984; (j) the VH set forth as SEQ ID NO: 1029 and the VL set forth as SEQ ID NO: 1030; (k) the VH set forth as SEQ ID NO: 1035 and the VL set forth as SEQ ID NO: 1036; (l) the VH set forth as SEQ ID NO: 1039 and the VL set forth as SEQ ID NO: 1040; (m) the VH set forth as SEQ ID NO: 1069 and the VL set forth as SEQ ID NO: 1070; (n) the VH set forth as SEQ ID NO: 1103 and the VL set forth as SEQ ID NO: 1104; (o) the VH set forth as SEQ ID NO: 1107 and the VL set forth as SEQ ID NO: 1108; (p) the VH set forth as SEQ ID NO: 1111 and the VL set forth as SEQ ID NO: 1112; (q) the VH set forth as SEQ ID NO: 1121 and the VL set forth as SEQ ID NO: 1122; (r) the VH set forth as SEQ ID NO: 1133 and the VL set forth as SEQ ID NO: 1134; (s) the VH set forth as SEQ ID NO: 1157 and the VL set forth as SEQ ID NO: 1158; (t) the VH set forth as SEQ ID NO: 1225 and the VL set forth as SEQ ID NO: 1226; (u) the VH set forth as SEQ ID NO: 1243 and the VL set forth as SEQ ID NO: 1244; (v) the VH set forth as SEQ ID NO: 1251 and the VL set forth as SEQ ID NO: 1252; (w) the VH set forth as SEQ ID NO: 1255 and the VL set forth as SEQ ID NO: 1256; (x) the VH set forth as SEQ ID NO: 1269 and the VL set forth as SEQ ID NO: 1270; (y) the VH set forth as SEQ ID NO: 3275 and the VL set forth as SEQ ID NO: 3276; (z) the VH set forth as SEQ ID NO: 3361 and the VL set forth as SEQ ID NO: 3362; (aa) the VH set forth as SEQ ID NO: 3365 and the VL set forth as SEQ ID NO: 3366; (bb) the VH set forth as SEQ ID NO: 3421 and the VL set forth as SEQ ID NO: 3422; (cc) the VH set forth as SEQ ID NO: 3447 and the VL set forth as SEQ ID NO: 3448; (dd) the VH set forth as SEQ ID NO: 3515 and the VL set forth as SEQ ID NO: 3516; (ee) the VH set forth as SEQ ID NO: 3605 and the VL set forth as SEQ ID NO: 3606; (ff) the VH set forth as SEQ ID NO: 3647 and the VL set forth as SEQ ID NO: 3648; (gg) the VH set forth as SEQ ID NO: 3649 and the VL set forth as SEQ ID NO: 3650; (hh) the VH set forth as SEQ ID NO: 3725 and the VL set forth as SEQ ID NO: 3726; (ii) the VH set forth as SEQ ID NO: 3835 and the VL set forth as SEQ ID NO: 3836; (jj) the VH set forth as SEQ ID NO: 3845 and the VL set forth as SEQ ID NO: 3846; (kk the VH set forth as SEQ ID NO: 3853 and the VL set forth as SEQ ID NO: 3854; (ll) the VH set forth as SEQ ID NO: 3873 and the VL set forth as SEQ ID NO: 3874; (mm) the VH set forth as SEQ ID NO: 4949 and the VL set forth as SEQ ID NO: 4950; (nn) the VH set forth as SEQ ID NO: 5029 and the VL set forth as SEQ ID NO: 5030; (oo) the VH set forth as SEQ ID NO: 5131 and the VL set forth as SEQ ID NO: 5132; (pp) the VH set forth as SEQ ID NO: 5217 and the VL set forth as SEQ ID NO: 5218; or (qq) the VH set forth as SEQ ID NO: 5311 and the VL set forth as SEQ ID NO: 5312.

In some embodiments, the anti-SARS-CoV-2 antibodies or antigen binding fragments provided herein are antibodies that block SARS-CoV-2 binding to ACE2, i.e., ACE2 blockers. In particular embodiments, ACE2-blocking anti-SARS-CoV-2 antibodies or antigen binding fragments comprise: (i) three CDRs in the heavy chain variable region (VH) set forth as SEQ ID NO: 729 and three CDRs in the light chain variable region (VL) set forth as SEQ ID NO: 730; (ii) three CDRs in the VH set forth as SEQ ID NO: 891 and three CDRs in the VL set forth as SEQ ID NO: 892; (iii) three CDRs in the VH set forth as SEQ ID NO: 961 and three CDRs in the VL set forth as SEQ ID NO: 962; (iv) three CDRs in the VH set forth as SEQ ID NO: 979 and three CDRs in the VL set forth as SEQ ID NO: 980; (v) three CDRs in the VH set forth as SEQ ID NO: 1039 and three CDRs in the VL set forth as SEQ ID NO: 1040; (vi) three CDRs in the VH set forth as SEQ ID NO: 1103 and three CDRs in the VL set forth as SEQ ID NO: 1104; (vii) three CDRs in the VH set forth as SEQ ID NO: 1107 and three CDRs in the VL set forth as SEQ ID NO: 1108; (viii) three CDRs in the VH set forth as SEQ ID NO: 1111 and three CDRs in the VL set forth as SEQ ID NO: 1112; (ix) three CDRs in the VH set forth as SEQ ID NO: 1121 and three CDRs in the VL set forth as SEQ ID NO: 1122; (x) three CDRs in the VH set forth as SEQ ID NO: 1133 and three CDRs in the VL set forth as SEQ ID NO: 1134; (xi) three CDRs in the VH set forth as SEQ ID NO: 1157 and three CDRs in the VL set forth as SEQ ID NO: 1158; (xii) three CDRs in the VH set forth as SEQ ID NO: 1143 and three CDRs in the VL set forth as SEQ ID NO: 1144; (xiii) three CDRs in the VH set forth as SEQ ID NO: 1251 and three CDRs in the VL set forth as SEQ ID NO: 1252; (xiv) three CDRs in the VH set forth as SEQ ID NO: 1255 and three CDRs in the VL set forth as SEQ ID NO: 1256; (xv) three CDRs in the VH set forth as SEQ ID NO: 3421 and three CDRs in the VL set forth as SEQ ID NO: 3422; (xvi) three CDRs in the VH set forth as SEQ ID NO: 3447 and three CDRs in the VL set forth as SEQ ID NO: 3448; (xvii) three CDRs in the VH set forth as SEQ ID NO: 3515 and three CDRs in the VL set forth as SEQ ID NO: 3516; (xviii) three CDRs in the VH set forth as SEQ ID NO: 3605 and three CDRs in the VL set forth as SEQ ID NO: 3606; (xvix) three CDRs in the VH set forth as SEQ ID NO: 3649 and three CDRs in the VL set forth as SEQ ID NO: 3650; (xx) three CDRs in the VH set forth as SEQ ID NO: 3853 and three CDRs in the VL set forth as SEQ ID NO: 3854; (xxi) three CDRs in the VH set forth as SEQ ID NO: 4949 and three CDRs in the VL set forth as SEQ ID NO: 4950; (xxii) three CDRs in the VH set forth as SEQ ID NO: 5029 and three CDRs in the VL set forth as SEQ ID NO: 5030; (xxiii) three CDRs in the VH set forth as SEQ ID NO: 5131 and three CDRs in the VL set forth as SEQ ID NO: 5132; (xxiv) three CDRs in the VH set forth as SEQ ID NO: 5217 and three CDRs in the VL set forth as SEQ ID NO: 5218; or (xxv) three CDRs in the VH set forth as SEQ ID NO: 5311 and three CDRs in the VL set forth as SEQ ID NO: 5312, wherein the CDRs are defined by Kabat, Chothia, MacCallum or North numbering.

In other embodiments, ACE2-blocking anti-SARS-CoV-2 antibodies or antigen binding fragments comprise: (i) the VH set forth as SEQ ID NO: 729 and the VL set forth as SEQ ID NO: 730; (ii) the VH set forth as SEQ ID NO: 891 and the VL set forth as SEQ ID NO: 892; (iii) the VH set forth as SEQ ID NO: 961 and the VL set forth as SEQ ID NO: 962; (iv) the VH set forth as SEQ ID NO: 979 and the VL set forth as SEQ ID NO: 980; (v) the VH set forth as SEQ ID NO: 1039 and the VL set forth as SEQ ID NO: 1040; (vi) the VH set forth as SEQ ID NO: 1103 and the VL set forth as SEQ ID NO: 1104; (vii) the VH set forth as SEQ ID NO: 1107 and the VL set forth as SEQ ID NO: 1108; (viii) the VH set forth as SEQ ID NO: 1111 and the VL set forth as SEQ ID NO: 1112; (ix) the VH set forth as SEQ ID NO: 1121 and the VL set forth as SEQ ID NO: 1122; (x) the VH set forth as SEQ ID NO: 1133 and the VL set forth as SEQ ID NO: 1134; (xi) the VH set forth as SEQ ID NO: 1157 and the VL set forth as SEQ ID NO: 1158; (xii) the VH set forth as SEQ ID NO: 1143 and the VL set forth as SEQ ID NO: 1144; (xiii) the VH set forth as SEQ ID NO: 1251 and the VL set forth as SEQ ID NO: 1252; (xiv) the VH set forth as SEQ ID NO: 1255 and the VL set forth as SEQ ID NO: 1256; (xv) the VH set forth as SEQ ID NO: 3421 and the VL set forth as SEQ ID NO: 3422; (xvi) the VH set forth as SEQ ID NO: 3447 and the VL set forth as SEQ ID NO: 3448; (xvii) the VH set forth as SEQ ID NO: 3515 and the VL set forth as SEQ ID NO: 3516; (xviii) the VH set forth as SEQ ID NO: 3605 and the VL set forth as SEQ ID NO: 3606; (xvix) the VH set forth as SEQ ID NO: 3649 and the VL set forth as SEQ ID NO: 3650; (xx) the VH set forth as SEQ ID NO: 3853 and the VL set forth as SEQ ID NO: 3854; (xxi) the VH set forth as SEQ ID NO: 4949 and the VL set forth as SEQ ID NO: 4950; (xxii) the VH set forth as SEQ ID NO: 5029 and the VL set forth as SEQ ID NO: 5030; (xxiii) the VH set forth as SEQ ID NO: 5131 and the VL set forth as SEQ ID NO: 5132; (xxiv) the VH set forth as SEQ ID NO: 5217 and the VL set forth as SEQ ID NO: 5218; or (xxv) the VH set forth as SEQ ID NO: 5311 and the VL set forth as SEQ ID NO: 5312.

The amino acid sequences of the antibodies described in the foregoing paragraphs are provided below:

```
292-VH
                                        (SEQ ID NO: 729)
EVQLVESGGGLIQPGGSLRLSCAASGFTVSSNYMSWVRQAPGKGLEWVS
VIYSGGSTYYADSVKGRFTISRDNSKNTLYLQMNSLRAEDTAVYYCARD
LQGGGGPWGQGTLVTVSS

292-VL
                                        (SEQ ID NO: 730)
AIQMTQSPSSLSASVGDRVTITCRASQGIRNDLGWYQQKPGKAPKLLIY
AASSLQSGVPSRFSGSGSGTDFTLTISSLQPEDFATYYCLQDYNYPRTF
GQGTKVEIK

309-VH
                                        (SEQ ID NO: 763)
QVQLVESGGGVVQPGRSLRLSCAASGFTFSSYAMHWVRQAPGKGLEWVA
VISYDGSNKYYADSVKGRFTISRDNSKNTLYLQMNSLRAEDTAVYYCAR
PYSGSYQSYFDYWGQGTLVTVSS

309-VL
                                        (SEQ ID NO: 764)
EIVMTQSPGTLSLSPGERATLSCRASQSVSSSYLAWYQQKPGQAPRLLI
YGASSRATGIPDRFSGSGSGTDFTLTISRLEPEDFAVYYCQQYGSSPLT
FGGGTKVEIK
```

-continued

```
364-VH
                                        (SEQ ID NO: 873)
EVQLVESGGGLVQPGRSLRLSCTASGFTFGDYAMSWFRQAPGKGLEWVG
FIRSKAYGGTTEYAASVKGRFTISRDDSKSIAYLQMNSLKTEDTAVYYC
TRFGIDYDYIWGSYRYTTLFDYWGQGTLVTVSS

364-VL
                                        (SEQ ID NO: 874)
DIQMTQSPSTLSASVGDRVTITCRASQSISSWLAWYQQKPGKAPKLLIY
KASSLESGVPSRFSGSGSGTEFTLTISSLQPDDFATYYCQQYNSYSYTF
GQGTKLEIK

373-VH
                                        (SEQ ID NO: 891)
QVQLQESGPGLVKPSETLSLTCTVSGGSISSYYWSWIRQPPGKGLEWIG
YIYYSGSTNYNPSLKSRVTISVDTSKNQFSLKLSSVTAADTAVYYCARG
PDYYDFWSGYFYGMDVWGQGTTVTVSS

373-VL
                                        (SEQ ID NO: 892)
EIVLTQSPGTLSLSPGERATLSCRASQSVSSSYLAWYQQKPGQAPRLLI
YGASSRATGIPDRFSGSGSGTDFTLTISRLEPEDFAVYYCQQYGSSLTF
GGGTKVEIK

388-VH
                                        (SEQ ID NO: 921)
QVQLVESGGGVVQPGRSLRLSCAASGFTFNSYAIHWVRQAPGKGLEWVA
VISYDGSNKYYADSVKGRFTISRDNSKNTLYLQMNSLRAEDTAVYYCAR
GRGGYRSYFDYWGQGTLVTVSS

388-VL
                                        (SEQ ID NO: 922)
EIVLTQSPGTLSLSPGERATLSCRASQSVSSSYLAWYQQKPGQAPRLLI
YGASSRATGIPDRFSGSGSGTDFTLTISRLEPEDFAVYYCQQYGSSPNT
FGQGTKLEIK

408-VH
                                        (SEQ ID NO: 961)
QVQLVESGGGVVQPGRSLRLSCAASGFTFSSYAMHWVRQAPGKGLEWVA
VISYDGSNKYYADSVKGRFTISRDNSRNTLYLQMNSLRAEDTAVYYCAK
GADTPHYSGYDFLSVGYYYYGMDVWGQGTTVTVSS

408-VL
                                        (SEQ ID NO: 962)
DIQMTQSPSSLSASVGDRVTITCRASQSISSYLNWYQQKPGKAPKLLIY
AASSFQSGVPSRFSGSRSGTDFTLTISSLQPEDFATYYCQQSYSAPFTF
GPGTKVDIK

414-VH
                                        (SEQ ID NO: 973)
QVQLVQSGAEVKKPGASVKVSCKASGYTFTSYYMHWVRQAPGQGLEWMG
IINPSGGSTSYAQKFQGRVTMTRDTSTSTVYMELSSLRSEDTAVYYCAR
DPPGRDFWSGYYFGAPDYYYYYGMDVWGQGTTVTVSS

414-VL
                                        (SEQ ID NO: 974)
DIQMTQSPSSLSASVGDRVTITCRASQGISNYLAWFQQKPGKAPKSLIY
AASSLQSGVPSKFSGSGSGTDFTLTISSLQPEDFATYYCQQYNSYPYTF
GQGTKLEIK

417-VH
                                        (SEQ ID NO: 979)
QLQLQESGPGLVKPSETLSLTCTVSGGSISSSSYYWGWIRQPPGKGLEW
IGSIYYSGSTYYNPSLKSRVTISVDTSKNQFSLKLSSVTAADTAVYYCA
RAPIMITFGGVTGHFDYWGQGTLVTVSS

417-VL
                                        (SEQ ID NO: 980)
EIVLTQSPGTLSLSPGERATLSCRASQSVSSSYLAWYQQKPGQAPRLLI
YGASSRATGIPDRFSGSGSGTDFTLTISRLEPEDFAVYYCQQYGSSPLT
FGGGTKVEIK

419-VH
                                        (SEQ ID NO: 983)
QVQLVQSGAEVKKPGASVKVSCKASGYTFTSYYMHWVRQAPGQGLEWMG
IINPSGGSTSYAQKFQGRVTMTRDTSTSTVYMELSSLRSEDTAVYYCAR
DWTQSSGYDYYYGLDVWGQGTTVTVSS
```

419-VL (SEQ ID NO: 984)
SYELTQPPSVSVSPGQTARITCSGDALPKQYAYWYQQKPGQAPVVVIYK
DSERPSGIPERFSGSSSGTTVTLTISGVQAEDEADYYCQSADSSGTYVV
FGGGTKLTVL

442-VH (SEQ ID NO: 1029)
QVQLVESGGGVVQPGRSLRLSSAASGFTFSSYAMHWVRQAPGKGLEWVA
VISYDGSNKYYADSVRGRFTISRDNSKNTLYLQMNSLRAEDTAVYYCAR
PKGGSYSDAFDIWGQGTMVTVSS

442-VL (SEQ ID NO: 1030)
EIVLTQSPGTLSLSPGERATLSCRASQSVSSSYLAWYQQKPGQAPRLLI
YGASSRATGIPDRFSGSGSGTDFTLTISRLEPEDFAVYYCQQYGSSPQS
FGPGTKVDIK

445-VH (SEQ ID NO: 1035)
QVQLVQSGAEVKKPGASVKVSCKASGYTFTSYYMHWVRQAPGQGLEWMG
IINPSGGSTSYAQKFQGRVTMTRDTSTSTVYMELSSLRSEDTAVYYCAR
DPTEVGATSEYYYYGMDVWGQGTTVTVSS

445-VL (SEQ ID NO: 1036)
SYELTQPPSVSVSPGQTARITCSGDALPKQYAYWYQQKPGQAPVLVIYK
DSERPSGIPERFSGSSSGTTVTLTISGVQAEDEADYYCQSADSSGTYVV
FGGGTKLTVL

447-VH (SEQ ID NO: 1039)
EVQLVESGGGLVQPGGSLRLSCAASGFTVSSNYMSWVRQAPGKGLEWVS
VIYSGGSTYYADSVKGRFTISRDNSKNTLYLQMNSLRAEDTAVYYCARD
KSSGSGPWGQGTLVTVSS

447-VL (SEQ ID NO: 1040)
AIQMTQSPSSLSASVGDRVTITCRASQGIRNDLGWYQQKPGKAPKLLIY
AASSLQSGVPSRFSGSGSGTDFTLTISSLQPEDFATYYCLQDYNYPRTF
GQGTKVEIK

462-VH (SEQ ID NO: 1069)
QVQLVESGGGVVQPGRSLRLSCAASGFTFSSYGMHWVRQAPGKGLEWVA
VIWYDGNNKYYADSVKGRFTISRDNSKNTLYLQMNSLRAEDTAVYYCAK
DPTWFGELPSYYYYGMDVWGQGTTVTVSS

462-VL (SEQ ID NO: 1070)
DIQMTQSPSTLSASVGDRVTITCRASQSISSWLAWYQQKPGKAPKLLIY
KASSLESGVPSRFSGSGSGTEFTLTISSLQPDDFATYYCQQYNSYPPIT
FGQGTRLEIK

479-VH (SEQ ID NO: 1103)
EVQLVESGGGLVQPGGSLRLSCAASGFTFSSYSMNWVRQAPGKGLEWVS
YISSSSSTIYYADSVKGRFTISRDNAKNSLYLQMNSLRAEDTAVYYCAR
DLGARTPWDIVVVPAAMDYWGQGTLVTVSS

479-VL (SEQ ID NO: 1104)
EIVLTQSPGTLSLSPGERATLSCRASQSVSSSYLAWYQQKPGQAPRLLI
YGASSRATGIPDRFSGSGSGTDFTLTISRLEPEDFAVYYCQQYGRSPNT
FGQGTKLEIK

481-VH (SEQ ID NO: 1107)
EVQLVESGGGLIQPGGSLRLSCAASGFTVSSNYMSWVRQAPGKGLEWVS
VIYSGGSTFYADSVKGRFTISRDNSKNTLYLQMNSLRAEDTAVYYCARE
VAGTYDYWGQGTLVTVSS

481-VL (SEQ ID NO: 1108)
DIQMTQSPSSVSASVGDRVTITCRASQGISSWLAWYQQKPGKAPKLLIY
AASSLQSGVPSRFSGSGSGTDFTLTISSLQPEDFATYYCQQANSFPGGT
FGPGTKVDIK

483-VH (SEQ ID NO: 1111)
QVQLQESGPGLVKPSETLSLTCTVSGGSISSYYWSWIRQPPGKGLEWIG
YIYYSGSTNYNPSLKSRVTISVDTSKNQFSLKLSSVTAADTAVYYCARA
PEEKSSEIGELVGWGWFDPWGQGTLVTVSS

483-VL (SEQ ID NO: 1112)
SYELTQPPSVSVSPGQTASIICSGDKLGDKYACWYQQKPGQSPVLVIYQ
DSKRPSGIPERFSGSNSGNTATLTISGTQAMDEADYYCQAWDSSTVVFG
GGTKLTVL

488-VH (SEQ ID NO: 1121)
EVQLVESGGGLIQPGGSLRLSCAASGLTVSSNYMSWVRQAPGKGLEWVS
VIYSGGSTYYADSVKGRFTISRDNSKNTLYLQMNSLRAEDTAVYYCARS
PYGGNSWGQGTLVTVSS

488-VL (SEQ ID NO: 1122)
DIQMTQSPSSLSASVGDRVTITCQASQDISNYLNWYQQKPGKAPKLLIY
DASNLETGVPSRFSGSGSGTDFTFTISSLQPEDIATYYCQQYDNLPITF
GQGTRLEIK

494-VH (SEQ ID NO: 1133)
EVQLVESGGGLVQPGGSLRLSCAASGFTVSSNYMSWVRQAPGKGLEWVS
VIYSGGSTFYADSVKGRFTISRDNSKNTLYLQMNSLRAEDTAVYYCARD
SGDQLLDYWGQGTLVTVSS

494-VL (SEQ ID NO: 1134)
DIQLTQSPSFLSASVGDRVTITCRASQGISSYLAWYQQKPGKAPKLLIY
AASTLQSGVPSRFSGSGSGTEFTLTISSLQPEDFATYYCQQLNSYPPFT
FGPGTKVDIK

506-VH (SEQ ID NO: 1157)
QITLKESGPTLVKPTQTLTLTCTFSGFSLSTSGVGVGWIRQPPGKALEW
LALIYWDDDKRYSPSLKSRLTITKDTSKNQVVLTMTNMDPVDTATYYCA
HHSLSSIFDYWGQGTLVTVSS

506-VL (SEQ ID NO: 1158)
QSALTQPASVSGSPGQSITISCTGTSSDVGDYNYVSWYQQHPGKAPKLM
IYEVSNRPSGVSNRFSGSKSGNTASLTISGLQAEDEADYYCSSYTSSST
VFGGGTKLTVL

540-VH (SEQ ID NO: 1225)
EVQLVESGGGLVKPGGSLRLSCAASGFTFSNAWMSWVRQAPGKGLEWVG
HIKSKTDGGTTDYAAPVKGRFTISRDDSKNTLYLQMNSLKTEDTAVYYC
TREPYYFDYWGQGTLVTVSS

540-VL (SEQ ID NO: 1226)
DIQMTQSPSTLSASVGDRVTITCRASQSISSWLAWYQQKPGKAPKLLIY
KASSLESGVPSRFSGSGSGTEFTLTISSLQPDDFATYYCQQYNSYRYTF
GQGTKLEIK

549-VH (SEQ ID NO: 1243)
EVQLVESGGGLIQPGGSLRLSCAASGLTVSSNYMSWVRQAPGKGLEWVS
VIYSGGSTYYADSVKGRFTISRDNSKNTLYLQMNSLRAEDTAVYYCARS
PYGGNSWGQGTLVTVSS

549-VL (SEQ ID NO: 1244)
DIQMTQSPSSLSASVGDRVTITCRTSQTIYNYLNWYQQKPGKAPKFLIY
AASSFQNGVPSRFSGSGSGTDFTFTISSLQPEDFATYYCQQGYSTPLTF
GGGTKVEIK

553-VH (SEQ ID NO: 1251)
QVQLVQSGAEVKKPGASVKVSCKASGYTFTSYGISWVRQAPGQGLEWMG
WISAYNGNTNYAQKLQRVTMTTDTSTSTAYMELRSLRSDDTAVYYCAR
DRGYAATFGVFDYWGQGTLVTVSS

553-VL
(SEQ ID NO: 1252)
DIQMTQSPSSLSASVGDRVTITCRASQSISSYLNWYQQKPGKAPKLLIS
AASSLQSGVPSRFSGSGSGTDFTLTISSLQPEDFATYYCQQSYSTAFTF
GPGTKVDIK

555-VH
(SEQ ID NO: 1255)
QVQLVQSGAEVKKPGSSVKVSCKASGGTFSNYAISWVRQAPGQGLEWMG
RIIPILGIANYAQKFQGRVTITADKSTSTAYMELSSLRSEDTAVYYCAR
GYYEARHYYYYYAMDVWGQGTAVTVSS

555-VL
(SEQ ID NO: 1256)
DIQMTQSPSSLSASVGDRVTITCRASQSISSYLSWYQQKPGKAPKLLIY
AASSLQSGVPSRFSGSGSGTDFTLTITSSLQPEDFATYYCQQSYSTPRTF
GQGTKVEIK

562-VH
(SEQ ID NO: 1269)
QVQLVESGGGVVQPGRSLRLSCAASGFTFSSYAMHWVRQAPGKGLEWVA
VISYDGSNKYYADSVKGRFTISRDNSKNTLYLQMNSLRAEDTAVYYCAR
ASSGGYQGPFDPWGQGTLVTVSS

562-VL
(SEQ ID NO: 1270)
QSALTQPASVSGSPGQSITISCTGTSSDVGGYNYVSWYQQHPGKAPKLM
IYDVSNRPSGVSNRFSGSKSGNTASLTISGLQAEDEADYYCSSYTSSST
LLYVFGTGTKVTVL

851-VH
(SEQ ID NO: 3275)
QITLKESGPTLVKPTQTLTLTCTFSGFSLSTNGVGMGWIRQPPGKALEW
LALIYWDDDQFYSPSLKSRLTITRDTSKNQVVLTMTNMDPVDTATYYCA
QAFYESFGFYSWGQGTLVTVSS

851-VL
(SEQ ID NO: 3276)
NFMLTQPHSVSESPGKTVIISCTRSIGSIASNYVQWYQQRPGSAPTIVV
FEDNERPSGVPDRFSGSIDRSSNSASLTISGLKTEDEADYYCQSYDGSS
ELVFGGGTKLTVL

894-VH
(SEQ ID NO: 3361)
QVQLVQSGAEVKKPGASVKVSCKVSGYTLPELSIHWVRQAPGKGLEWMG
GFDPENAETIYTQKFQGRLTMTEDTSTDTAYMELSSLRSEDTAMYYCAT
SFVLMPAALGDYSYYYGMDVWGQGTTVTVSS

894-VL
(SEQ ID NO: 3362)
DIVMTQTPLSSPVTLGQPASISCRSSQSLVHSDGNTYLSWLQQRPGQPP
RLLIYKISNRFSGVPDRFSGSGAGTDFTLKISRVEAEDVGVYYCMQATQ
FPLTFGGGTKVEIK

896-VH
(SEQ ID NO: 3365)
EVQLVESGGGVVQPGGSLRLSCAASGFTFDDYAMHWVRQVPGKGLEWVS
LISGDGGSTYYADSVKGRFTISRDNSKNSLYVQMNSLRTEDTALYYCVK
DRGGSGWDLNHYYYGMDVWGQGTTVTVSS

896-VL
(SEQ ID NO: 3366)
DIQLTQSPSFLSASVGDRVTVTCRASQGISSYLAWYQQKPGKAPKLLIY
AAYTLQSGVPSRFSGSGSETEFTLTISSLQPEDFATYYCQQVKSYPLTF
GGGTKVEIK

923-VH
(SEQ ID NO: 3421)
EVQLVESGGGVVRPGGSLRLSCAASGFIFDDYDMTWVRQAPGKGLEWVS
GISWNGGNTGYADSVKGRFTISRDNAKNSLYLQMNSLRAEDTALYHCAV
IMSPIPRYSGYDWAGGAFDIWGQGTMVTVSS

923-VL
(SEQ ID NO: 3422)
SSELTQDPAVSVALGQTVRITCQGDSLRSYYASWYQQKPGQVPILVIYD
KNNRPSGIPDRFSGSSSGNTASLTITGAQAEDEADYYCNSRDSSGNAVV
FGGGTKLTVL

936-VH
(SEQ ID NO: 3447)
EVQLVESGGGLVQPGRSLTLSCAGSGFTFDDYAMHWVRQAPGKGLEWVS
GISWNSGSIGYADSVKGRFTISRDNAKNSLYLQMNSLRAEDTALYYCAK
DVSYDSSGYYNNAFDIWGQGTMVTVSS

936-VL
(SEQ ID NO: 3448)
DIQLTQSPSFLSASVGDRVTITCRASQGISSYLAWYQQKPGKAPKLLIY
AASTLQSGVPSRFSGSGSGTEFTLTISSLQPEDFATYYCQQLYSYPVTF
GQGTRLEIK

970-VH
(SEQ ID NO: 3515)
EVQLVESGGGLVQPGGSLRLSCAASGFTFSSYWMSWVRQAPGKGLEWVA
NINKDGSEKYYVDSVKGRFTISRDNAKNSLYLQMNSLRAEDTAVYFCAR
DYRYFDWLLSQIDLEIDYFDYWGQGTLVTVSS

970-VL
(SEQ ID NO: 3516)
DIQMTQSPSSLSASVGDRVTITCRASQSISSYLNWYQQKPGKAPKVLIY
AASSLQSGVPSRFSGSGSGTDFTLTISSLQPEDFATYYCQQSYSTPLTF
GGGTKVEIK

1015-VH
(SEQ ID NO: 3605)
EVQLVESGGGLVQPGGSLRLSCAASGFTFSSYWMHWVRQAPGKGLVWVS
HINSDGSSTSYADSVKGRFTISRDNAKNTLYLQMNSLRAEDTAVYYCAR
GLRYFDLDVWGQGTTVTVSS

1015-VL
(SEQ ID NO: 3606)
QSVLTQPPSVSEAPRQRVTISCSGSSSNIGNNAVNWYQQLPGKAPKLLI
FYDDLLPSGVSDRFSGSKSGTSASLAISGLQSEDEADYYCAAWDDSLNG
GVFGGGTKLTVL

1036-VH
(SEQ ID NO: 3647)
QVQLVQSGAEVKKPGSSVKVSCKASGGTLSSYTISWVRQAPGQGLEWMG
RIIPILGIADYAQKFQGRVTITADKSTTTAYMDLSSLGSEDTALYYCAS
APKDWSSGFDYYYGMDVWGQGTMVTVSS

1036-VL
(SEQ ID NO: 3648)
DIVMTQTPLSLSVTPGQPASISCKSSQSLLNSDGKTYLYWYLQKAGQPP
QLLIYEVSNRFSGVPERFSGSGSGTDFTLKISRVEAEDVGVYYCMQSVQ
LPPYTFGQGTKLEIT

1037-VH
(SEQ ID NO: 3649)
QITLKESGPTLVKPTQTLTLTCTFSGFSLSTSGVGVGWIRQPPGKALEW
LALIYWDDDKRYSPSLKSRLTITKDTSKNQVVLTMTNMDPVDTATYYCA
HHTITRINDYWGQGTLVTVSS

1037-VL
(SEQ ID NO: 3650)
QSALTQPASVSGSPGQSITISCTATSSDVGAYNYVSWYQQHPGKAPKLM
IYDVSKRPSGVSNRFSGSKSGNTASLTISGLQAEDEADYYCSSYTSSST
VFGGGTKLTVL

1075-VH
(SEQ ID NO: 3725)
QVQLVQSGAEVKKPGASVKVSCKVSGYTLIELSMHWVRQAPGKGLEWMG
GFDPEDGETIYAQKFQGRVTMTEDTSTDTAYMELSSLRSEDTAVYYCAT
EWAYYGSGSYLGYWGQGTLVTVSS

1075-VL
(SEQ ID NO: 3726)
EIVMTQSPATLSVSPGERATLSCRASQSVSSNLAWFQQKPGQAPRLLIY
GASTRVTVIPARFSGSGSGTEFTLTISSLQSEDFAVYYCQQYNNWPRTF
GQGTKVEIK

1130-VH
(SEQ ID NO: 3835)
QVQLVQSGAEVKKPGSSVKVSCKASGGTFSSNTISWVRQAPGQGLEWMG
RIIPLLGTVNYAQKFQGRVTITADKSTTTAYMELSSLRSEDTAVYYCAR
DAGGITIFGVEHYYYYMDVWGKGTTVTVTS

1130-VL (SEQ ID NO: 3836)
EIVLTQSPGTLSLSPGERATLSCRASQSVSSSHLAWYQQKPGQAPRLLI
YDASSRATGIPDRFSGSGSGTDFTLTISRLEPEDFAVYYCQQYGSSPPM
YTFGQGTKLEIK

1135-VH (SEQ ID NO: 3845)
EVQLVESGGGLVQPGRSLRLSCAASGLTFEDYAMHWVRQVPGKGLEWVS
GISWNSGTIGYADSVKGRFIISRDNAKNSLYLQMRSLRAEDTALYYCAK
DVGFGELLYYAFDIWGQGTMVTVSS

1135-VL (SEQ ID NO: 3846)
QSALTQPASVSGSPGQSITISCTGTSSDVGGYNYVSWYQQHPGKAPKLM
IYDVSNRPSGVSNRFSGSKSGNTASLTISGLQAEDEADYYCSSYTSSST
VVFGGGTKLTVL

1139-VH (SEQ ID NO: 3853)
QVQLVQSGAEVKKPGASVKVSCKASGYTFSSYEINWVRQATGQGLEWMG
RMTLNSGNTGYAQNFQGRVTMTRDTSISTAYMELSGLRSEDTAVYYCAR
MRSGWPTHGRPDDYWGQGTLVTVSS

1139-VL (SEQ ID NO: 3854)
QSVLTQPPSASGTPGQRVTISCSGSNSNIGSYTVNWYQQLPGTAPKLLI
YGNNQRPSGVPDRFSGSKSGTSASLAISGLQSEDEADYYCLAWDDSRNG
LVFGGGTKLTVL

1149-VH (SEQ ID NO: 3873)
QVQLVQSGAEVKKPGASVKVSCKASGYTFASYDINWVRQATGQGPEWMG
WMIPNIGNTGYAQKFQGRVTMTRNTSISTAYMELSSLTSEDTAVYYCAR
VSRLFNDFGLRHEAPVDFWGQGTRVTVSS

1149-VL (SEQ ID NO: 3874)
QSVLTQPPSVSGAPGQRVTISCTGSSSNIGAGYDVHWYQQLPGTAPKLL
IYGYSSRPSGVPDRFSGSKSGTSASLAITGLQAEDEADYYCQSYDSSLS
VLFGGGTKLTVL

1404-VH (SEQ ID NO: 4949)
QITLKESGPTLVKPTQTLTLTCTFSGFSLSISGVGVGWLRQPPGKALEW
LALIYWDDDKRYSPSLKSRLTISKDTSKNQVVLKMTNIDPVDTATYYCA
HHSISTIFDHWGQGTLVTVSS

1404-VL (SEQ ID NO: 4950)
QSALTQPASVSGSPGQSITISCTATSSDVGDYNYVSWYQQHPGKAPKLM
IFEVSDRPSGISNRFSGSKSGNTASLTISGLQAEDEADYYCSSYTTSSA
VFGGGTKLTVL

1444-VH (SEQ ID NO: 5029)
QVQLVQSGAEVKKPGASVKVSCKASGYTFTAYYMHWVRQAPGQGLEWMG
WINPNSDDTNYAQKFQGRVTMTRDTSISTAYMELSRLRSDDTAVYYCAR
EEGVFTIGDRYFDLWGRGTLVSVSS

1444-VL (SEQ ID NO: 5030)
QTVVTQEPSFSVSPGGTVTLTCGLSSGSVSTSYYPSWYQQTPGQAPRTL
IYNTNTRSSGVPDRFSGSILGNKAALTITGAQADDESDYYCVLYMGSGI
WVFGGGTKLTVL

1495-VH (SEQ ID NO: 5131)
QVQLVESGGGVVQPGRSLRLSCTASGFTFSSYAMHWVRQAPGKGLEWVA
VISYDGNNKYYGDSVKGRFTISRDNSKNTLYLQMNSLRAEDTAVYYCAK
GADTPHYSGYHFLSVGYYFYGMDVWGQGTTVTVSS

1495-VL (SEQ ID NO: 5132)
DIQMTQSPSSLSASVGDRVTITCRASQSISYYLNWYQQKPGKAPQLLIY
AASSLQSGVPSRFSGSRSGTDFTLTISSLQPEDFATYYCQQSYSTPFTF
GPGTKVDIK

1538-VH (SEQ ID NO: 5217)
EVQLLESGGGLVQPGGSLRLSCAASGFTFSSYAMSWVRQAPGKGLEWVS
GISDSGGSTYYADYVKGRFTISRDNSKDTLYLQMNSLRAEDTAVYYCAK
DRGNEYALTHYYYYAMDVWGQGTTVTVSS

1538-VL (SEQ ID NO: 5218)
DIQMTQSPSSLSASVGDRVTITCRASQSISSYLNWYQQKPGKAPKLLIY
AAYSLQSGVPSRFSGGGSGTDFTLTISSLQPEDFATYFCQQSYSTPITF
GQGTRLEIK

1585-VH (SEQ ID NO: 5311)
QVQLVESGGGVVQPGRSLRLSCAASGFTFSRFTLHWVRQAPGKGLEWVA
VISYDGSNKYYADSVKGRFTISRDNSKSTLYLQMNSLRAEDTGVYYCAR
DPSTVTGYFDYWGQGTLVTVSS

1585-VL (SEQ ID NO: 5312)
SYVLTQPPSVSVAPGKTAKISCGGDSIGSKSVHWYQQKPGQAPVLVIYY
DNDRPSGIPERFSGSNSGNTATLTISRVEAGDEADYYCQVWDIGVVFGG
GTKLTVL

In some embodiments, the anti-SARS-CoV-2 antibodies provided herein have IgG1 isotype. In some embodiments, the anti-SARS-CoV-2 antibodies provided herein have IgG1m3 allotype.

In some embodiments, provided herein is an antibody comprising a heavy chain comprising SEQ ID NO: 5319 and a light chain comprising SEQ ID NO: 5320. In some embodiments, provided herein is an antibody comprising a heavy chain comprising SEQ ID NO: 5321 and a light chain comprising SEQ ID NO: 5322. In some embodiments, provided herein is an antibody comprising a heavy chain comprising SEQ ID NO: 5322 and a light chain comprising SEQ ID NO: 5323. In some embodiments, provided herein is an antibody comprising a heavy chain comprising SEQ ID NO: 5327 and a light chain comprising SEQ ID NO: 5328. In some embodiments, provided herein is an antibody comprising a heavy chain comprising SEQ ID NO: 5329 and a light chain comprising SEQ ID NO: 5330. In some embodiments, provided herein is an antibody comprising a heavy chain comprising SEQ ID NO: 5331 and a light chain comprising SEQ ID NO: 5332. In some embodiments, provided herein is an antibody comprising a heavy chain comprising SEQ ID NO: 5333 and a light chain comprising SEQ ID NO: 5334. In some embodiments, provided herein is an antibody comprising a heavy chain comprising SEQ ID NO: 5337 and a light chain comprising SEQ ID NO: 5338. In some embodiments, provided herein is an antibody comprising a heavy chain comprising SEQ ID NO: 5339 and a light chain comprising SEQ ID NO: 5340. In some embodiments, provided herein is an antibody comprising a heavy chain comprising SEQ ID NO: 5341 and a light chain comprising SEQ ID NO: 5342. In some embodiments, provided herein is an antibody comprising a heavy chain comprising SEQ ID NO: 5343 and a light chain comprising SEQ ID NO: 5344. In some embodiments, provided herein is an antibody comprising a heavy chain comprising SEQ ID NO: 5345 and a light chain comprising SEQ ID NO: 5346. In some embodiments, provided herein is an antibody comprising a heavy chain comprising SEQ ID NO: 5349 and a light chain comprising SEQ ID NO: 5350. In some embodiments, provided herein is an antibody comprising a heavy chain comprising SEQ ID NO: 5353 and a light chain comprising SEQ ID NO: 5354. In some embodiments, provided herein is an antibody comprising a heavy chain comprising SEQ ID NO: 5355 and a light chain comprising SEQ ID NO: 5356. In some embodiments, provided herein is an antibody comprising a heavy chain comprising SEQ ID NO: 5357 and a light chain comprising SEQ ID NO: 5358. In some embodiments, provided herein is an antibody comprising a heavy chain comprising SEQ ID NO: 5359 and a light chain comprising SEQ ID NO: 5360. In some embodiments, provided herein is an antibody comprising a heavy chain comprising SEQ ID NO: 5361 and a light chain comprising SEQ ID NO: 5362. In some embodiments, provided herein is an antibody comprising a heavy chain comprising SEQ ID NO: 5365 and a light chain comprising SEQ ID NO: 5366. In some embodiments, provided herein is an antibody comprising a heavy chain comprising SEQ ID NO: 5707 and a light chain comprising SEQ ID NO: 5708. In some embodiments, provided herein is an antibody comprising a heavy chain comprising SEQ ID NO: 5709 and a light chain comprising SEQ ID NO: 5710. In some embodiments, provided herein is an antibody comprising a heavy chain comprising SEQ ID NO: 5711 and a light chain comprising SEQ ID NO: 5712. In some embodiments, provided herein is an antibody comprising a heavy chain comprising SEQ ID NO: 5713 and a light chain comprising SEQ ID NO: 5714. In some embodiments, provided herein is an antibody comprising a heavy chain comprising SEQ ID NO: 5715 and a light chain comprising SEQ ID NO: 5716. In some embodiments, provided herein is an antibody comprising a heavy chain comprising SEQ ID NO: 5717 and a light chain comprising SEQ ID NO: 5718. In some embodiments, provided herein is an antibody comprising a heavy chain comprising SEQ ID NO: 5719 and a light chain comprising SEQ ID NO: 5720. In some embodiments, provided herein is an antibody comprising a heavy chain comprising SEQ ID NO: 5721 and a light chain comprising SEQ ID NO: 5722. In some embodiments, provided herein is an antibody comprising a heavy chain comprising SEQ ID NO: 5723 and a light chain comprising SEQ ID NO: 5724. In some embodiments, provided herein is an antibody comprising a heavy chain comprising SEQ ID NO: 5725 and a light chain comprising SEQ ID NO: 5726. In some embodiments, provided herein is an antibody comprising a heavy chain comprising SEQ ID NO: 5727 and a light chain comprising SEQ ID NO: 5728. In some embodiments, provided herein is an antibody comprising a heavy chain comprising SEQ ID NO: 5729 and a light chain comprising SEQ ID NO: 5730. In some embodiments, provided herein is an antibody comprising a heavy chain comprising SEQ ID NO: 5731 and a light chain comprising SEQ ID NO: 5732. In some embodiments, provided herein is an antibody comprising a heavy chain comprising SEQ ID NO: 5733 and a light chain comprising SEQ ID NO: 5734. In some embodiments, provided herein is an antibody comprising a heavy chain comprising SEQ ID NO: 5735 and a light chain comprising SEQ ID NO: 5736. In some embodiments, provided herein is an antibody comprising a heavy chain comprising SEQ ID NO: 5737 and a light chain comprising SEQ ID NO: 5738. In some embodiments, provided herein is an antibody comprising a heavy chain comprising SEQ ID NO: 5739 and a light chain comprising SEQ ID NO: 5740. In some embodiments, provided herein is an antibody comprising a heavy chain comprising SEQ ID NO: 5741 and a light chain comprising SEQ ID NO: 5742. In some embodiments, provided herein is an antibody comprising a heavy chain comprising SEQ ID NO: 5743 and a light chain comprising SEQ ID NO: 5744.

The amino acid sequences of the antibodies described in the preceding paragraph are provided below:

```
292 Heavy chain full length sequence
                                                         (SEQ ID NO: 5319)
EVQLVESGGGLIQPGGSLRLSCAASGFTVSSNYMSWVRQAPGKGLEWVSVIYSGGSTYYADSVKGRFTISR

DNSKNTLYLQMNSLRAEDTAVYYCARDLQGGGGPWGQGTLVTVSSASTKGPSVFPLAPSSKSTSGGTAAL

GCLVKDYFPEPVTVSWNSGALTSGVHTFPAVLQSSGLYSLSSVVTVPSSSLGTQTYICNVNHKPSNTKVDK

RVEPKSCDKTHTCPPCPAPELLGGPSVFLFPPKPKDTLMISRTPEVTCVVVDVSHEDPEVKFNWYVDGVEV

HNAKTKPREEQYNSTYRVVSVLTVLHQDWLNGKEYKCKVSNKALPAPIEKTISKAKGQPREPQVYTLPPSR

EEMTKNQVSLTCLVKGFYPSDIAVEWESNGQPENNYKTTPPVLDSDGSFFLYSKLTVDKSRWQQGNVFSC

SVMHEALHNHYTQKSLSLSPGK

292 Light chain full length sequence
                                                         (SEQ ID NO: 5320)
AIQMTQSPSSLSASVGDRVTITCRASQGIRNDLGWYQQKPGKAPKLLIYAASSLQSGVPSRFSGSGSGTDFT

LTISSLQPEDFATYYCLQDYNYPRTFGQGTKVEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

309 Heavy chain full length sequence
                                                         (SEQ ID NO: 5321)
QVQLVESGGGVVQPGRSLRLSCAASGFTFSSYAMHWVRQAPGKGLEWVAVISYDGSNKYYADSVKGRFT

ISRDNSKNTLYLQMNSLRAEDTAVYYCARPYSGSYQSYFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK
```

309 Light chain full length sequence (SEQ ID NO: 5322)

EIVMTQSPGTLSLSPGERATLSCRASQSVSSSYLAWYQQKPGQAPRLLIYGASSRATGIPDRFSGSGSGTDFT

LTISRLEPEDFAVYYCQQYGSSPLTFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

364 Heavy chain full length sequence (SEQ ID NO: 5323)

EVQLVESGGGLVQPGRSLRLSCTASGFTFGDYAMSWFRQAPGKGLEWVGFIRSKAYGGTTEYAASVKGRF

TISRDDSKSIAYLQMNSLKTEDTAVYYCTRFGIDYDYIWGSYRYTTLFDYWGQGTLVTVSSASTKGPSVFP

LAPSSKSTSGGTAALGCLVKDYFPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

364 Light chain full length sequence (SEQ ID NO: 5324)

DIQMTQSPSTLSASVGDRVTITCRASQSISSWLAWYQQKPGKAPKLLIYKASSLESGVPSRFSGSGSGTEFTL

TISSLQPDDFATYYCQQYNSYSYTFGQGTKLEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

373 Heavy chain full length sequence (SEQ ID NO: 5325)

QVQLQESGPGLVKPSETLSLTCTVSGGSISSYYWSWIRQPPGKGLEWIGYIYYSGSTNYNPSLKSRVTISVDT

SKNQFSLKLSSVTAADTAVYYCARGPDYYDFWSGYFYGMDVWGQGTTVTVSSASTKGPSVFPLAPSSKST

SGGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

373 Light chain full length sequence (SEQ ID NO: 5326)

EIVLTQSPGTLSLSPGERATLSCRASQSVSSSYLAWYQQKPGQAPRLLIYGASSRATGIPDRFSGSGSGTDFT

LTISRLEPEDFAVYYCQQYGSSLTFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

388 Heavy chain full length sequence (SEQ ID NO: 5327)

QVQLVESGGGVVQPGRSLRLSCAASGFTFNSYAIHWVRQAPGKGLEWVAVISYDGSNKYYADSVKGRFTI

SRDNSKNTLYLQMNSLRAEDTAVYYCARGRGGYRSYFDYWGQGTLVTVSSASTKGPSVFPLAPSSKSTSG

GTAALGCLVKDYFPEPVTVSWNSGALTSGVHTFPAVLQSSGLYSLSSVVTVPSSSLGTQTYICNVNHKPSNT

KVDKRVEPKSCDKTHTCPPCPAPELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPAPIEKTISKAKGQPREPQVYT

LPPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPGK

388 Light chain full length sequence (SEQ ID NO: 5328)

EIVLTQSPGTLSLSPGERATLSCRASQSVSSSYLAWYQQKPGQAPRLLIYGASSRATGIPDRFSGSGSGTDFT

LTISRLEPEDFAVYYCQQYGSSPNTFGQGTKLEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

408 Heavy chain full length sequence (SEQ ID NO: 5329)

QVQLVESGGGVVQPGRSLRLSCAASGFTFSSYAMHWVRQAPGKGLEWVAVISYDGSNKYYADSVKGRFT

ISRDNSRNTLYLQMNSLRAEDTAVYYCAKGADTPHYSGYDFLSVGYYYYGMDVWGQGTTVTVSSASTKG

PSVFPLAPSSKSTSGGTAALGCLVKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQPENNYKTTPPVLDSDGSFFLY

SKLTVDKSRWQQGNVFSCSVMHEALHNHYTQKSLSLSPGK

408 Light chain full length sequence (SEQ ID NO: 5330)

DIQMTQSPSSLSASVGDRVTITCRASQSISSYLNWYQQKPGKAPKLLIYAASSFQSGVPSRFSGSRSGTDFTL

TISSLQPEDFATYYCQQSYSAPFTFGPGTKVDIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

414 Heavy chain full length sequence (SEQ ID NO: 5331)

QVQLVQSGAEVKKPGASVKVSCKASGYTFTSYYMHWVRQAPGQGLEWMGIINPSGGSTSYAQKFQGRVT

MTRDTSTSTVYMELSSLRSEDTAVYYCARDPPGRDFWSGYYFGAPDYYYYGMDVWGQGTTVTVSSAST

KGPSVFPLAPSSKSTSGGTAALGCLVKDYFPEPVTVSWNSGALTSGVHTFPAVLQSSGLYSLSSVVTVPSSS

LGTQTYICNVNHKPSNTKVDKRVEPKSCDKTHTCPPCPAPELLGGPSVFLFPPKPKDTLMISRTPEVTCVVV

DVSHEDPEVKFNWYVDGVEVHNAKTKPREEQYNSTYRVVSVLTVLHQDWLNGKEYKCKVSNKALPAPIE

KTISKAKGQPREPQVYTLPPSREEMTKNQVSLTCLVKGFYPSDIAVEWESNGQPENNYKTTPPVLDSDGSFF

LYSKLTVDKSRWQQGNVFSCSVMHEALHNHYTQKSLSLSPGK

414 Light chain full length sequence (SEQ ID NO: 5332)

DIQMTQSPSSLSASVGDRVTITCRASQGISNYLAWFQQKPGKAPKSLIYAASSLQSGVPSKFSGSGSGTDFTL

TISSLQPEDFATYYCQQYNSYPYTFGQGTKLEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

417 Heavy chain full length sequence (SEQ ID NO: 5333)

QLQLQESGPGLVKPSETLSLTCTVSGGSISSSSYYWGWIRQPPGKGLEWIGSIYYSGSTYYNPSLKSRVTISV

DTSKNQFSLKLSSVTAADTAVYYCARAPIMITFGGVTGHFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

417 Light chain full length sequence (SEQ ID NO: 5334)

EIVLTQSPGTLSLSPGERATLSCRASQSVSSSYLAWYQQKPGQAPRLLIYGASSRATGIPDRFSGSGSGTDFT

LTISRLEPEDFAVYYCQQYGSSPLTFGGGTKVEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

419 Heavy chain full length sequence (SEQ ID NO: 5335)

QVQLVQSGAEVKKPGASVKVSCKASGYTFTSYYMHWVRQAPGQGLEWMGIINPSGGSTSYAQKFQGRVT

MTRDTSTSTVYMELSSLRSEDTAVYYCARDWTQSSGYDYYYGLDVWGQGTTVTVSSASTKGPSVFPLAPS

-continued

SKSTSGGTAALGCLVKDYFPEPVTVSWNSGALTSGVHTFPAVLQSSGLYSLSSVVTVPSSSLGTQTYICNVN

HKPSNTKVDKRVEPKSCDKTHTCPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGK

419 Light chain full length sequence (SEQ ID NO: 5336)

SYELTQPPSVSVSPGQTARITCSGDALPKQYAYWYQQKPGQAPVVVIYKDSERPSGIPERFSGSSSGTTVTLT

ISGVQAEDEADYYCQSADSSGTYVVFGGGTKLTVLGQPKAAPSVTLFPPSSEELQANKATLVCLISDFYPGA

VTVAWKADSSPVKAGVETTTPSKQSNNKYAASSYLSLTPEQWKSHRSYSCQVTHEGSTVEKTVAPTECS

442 Heavy chain full length sequence (SEQ ID NO: 5337)

QVQLVESGGGVVQPGRSLRLSSAASGFTFSSYAMHWVRQAPGKGLEWVAVISYDGSNKYYADSVRGRFTI

SRDNSKNTLYLQMNSLRAEDTAVYYCARPKGGSYSDAFDIWGQGTMVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

442 Light chain full length sequence (SEQ ID NO: 5338)

EIVLTQSPGTLSLSPGERATLSCRASQSVSSSYLAWYQQKPGQAPRLLIYGASSRATGIPDRFSGSGSGTDFT

LTISRLEPEDFAVYYCQQYGSSPQSFGPGTKVDIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

445 Heavy chain full length sequence (SEQ ID NO: 5339)

QVQLVQSGAEVKKPGASVKVSCKASGYTFTSYYMHWVRQAPGQGLEWMGIINPSGGSTSYAQKFQGRVT

MTRDTSTSTVYMELSSLRSEDTAVYYCARDPTEVGATSEYYYYGMDVWGQGTTVTVSSASTKGPSVFPLA

PSSKSTSGGTAALGCLVKDYFPEPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPVLDSDGSFFLYSKLTVD

KSRWQQGNVFSCSVMHEALHNHYTQKSLSLSPGK

445 Light chain full length sequence (SEQ ID NO: 5340)

SYELTQPPSVSVSPGQTARITCSGDALPKQYAYWYQQKPGQAPVLVIYKDSERPSGIPERFSGSSSGTTVTLT

ISGVQAEDEADYYCQSADSSGTYVVFGGGTKLTVLGQPKAAPSVTLFPPSSEELQANKATLVCLISDFYPGA

VTVAWKADSSPVKAGVETTTPSKQSNNKYAASSYLSLTPEQWKSHRSYSCQVTHEGSTVEKTVAPTECS

-continued

447 Heavy chain full length sequence (SEQ ID NO: 5341)

EVQLVESGGGLVQPGGSLRLSCAASGFTVSSNYMSWVRQAPGKGLEWVSVIYSGGSTYYADSVKGRFTIS

RDNSKNTLYLQMNSLRAEDTAVYYCARDKSSGSGPWGQGTLVTVSSASTKGPSVFPLAPSSKSTSGGTAA

LGCLVKDYFPEPVTVSWNSGALTSGVHTFPAVLQSSGLYSLSSVVTVPSSSLGTQTYICNVNHKPSNTKVD

KRVEPKSCDKTHTCPPCPAPELLGGPSVFLFPPKPKDTLMISRTPEVTCVVVDVSHEDPEVKFNWYVDGVE

VHNAKTKPREEQYNSTYRVVSVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGSFFLYSKLTVDKSRWQQGNVF

SCSVMHEALHNHYTQKSLSLSPGK

447 Light chain full length sequence (SEQ ID NO: 5342)

AIQMTQSPSSLSASVGDRVTITCRASQGIRNDLGWYQQKPGKAPKLLIYAASSLQSGVPSRFSGSGSGTDFT

LTISSLQPEDFATYYCLQDYNYPRTFGQGTKVEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

462 Heavy chain full length sequence (SEQ ID NO: 5343)

QVQLVESGGGVVQPGRSLRLSCAASGFTFSSYGMHWVRQAPGKGLEWVAVIWYDGNNKYYADSVKGRF

TISRDNSKNTLYLQMNSLRAEDTAVYYCAKDPTWFGELPSYYYYGMDVWGQGTTVTVSSASTKGPSVFPL

APSSKSTSGGTAALGCLVKDYFPEPVTVSWNSGALTSGVHTFPAVLQSSGLYSLSSVVTVPSSSLGTQTYIC

NVNHKPSNTKVDKRVEPKSCDKTHTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGK

462 Light chain full length sequence (SEQ ID NO: 5344)

DIQMTQSPSTLSASVGDRVTITCRASQSISSWLAWYQQKPGKAPKLLIYKASSLESGVPSRFSGSGSGTEFTL

TISSLQPDDFATYYCQQYNSYPPITFGQGTRLEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

479 Heavy chain full length sequence (SEQ ID NO: 5345)

EVQLVESGGGLVQPGGSLRLSCAASGFTFSSYSMNWVRQAPGKGLEWVSYISSSSSTIYYADSVKGRFTISR

DNAKNSLYLQMNSLRAEDTAVYYCARDLGARTPWDIVVVPAAMDYWGQGTLVTVSSASTKGPSVFPLAP

SSKSTSGGTAALGCLVKDYFPEPVTVSWNSGALTSGVHTFPAVLQSSGLYSLSSVVTVPSSSLGTQTYICNV

NHKPSNTKVDKRVEPKSCDKTHTCPPCPAPELLGGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTVDK

SRWQQGNVFSCSVMHEALHNHYTQKSLSLSPGK

-continued

479 Light chain full length sequence (SEQ ID NO: 5346)

EIVLTQSPGTLSLSPGERATLSCRASQSVSSSYLAWYQQKPGQAPRLLIYGASSRATGIPDRFSGSGSGTDFT
LTISRLEPEDFAVYYCQQYGRSPNTFGQGTKLEIKRTVAAPSVFIFPPSDEQLKSGTASVVCLLNNFYPREAK
VQWKVDNALQSGNSQESVTEQDSKDSTYSLSSTLTLSKADYEKHKVYACEVTHQGLSSPVTKSFNRGEC

481 Heavy chain full length sequence (SEQ ID NO: 5347)

EVQLVESGGGLIQPGGSLRLSCAASGFTVSSNYMSWVRQAPGKGLEWVSVIYSGGSTFYADSVKGRFTISR
DNSKNTLYLQMNSLRAEDTAVYYCAREVAGTYDYWGQGTLVTVSSASTKGPSVFPLAPSSKSTSGGTAAL
GCLVKDYFPEPVTVSWNSGALTSGVHTFPAVLQSSGLYSLSSVVTVPSSSLGTQTYICNVNHKPSNTKVDK
RVEPKSCDKTHTCPPCPAPELLGGPSVFLFPPKPKDTLMISRTPEVTCVVVDVSHEDPEVKFNWYVDGVEV
HNAKTKPREEQYNSTYRVVSVLTVLHQDWLNGKEYKCKVSNKALPAPIEKTISKAKGQPREPQVYTLPPSR
EEMTKNQVSLTCLVKGFYPSDIAVEWESNGQPENNYKTTPPVLDSDGSFFLYSKLTVDKSRWQQGNVFSC
SVMHEALHNHYTQKSLSLSPGK

481 Light chain full length sequence (SEQ ID NO: 5348)

DIQMTQSPSSVSASVGDRVTITCRASQGISSWLAWYQQKPGKAPKLLIYAASSLQSGVPSRFSGSGSGTDFT
LTISSLQPEDFATYYCQQANSFPGGTFGPGTKVDIKRTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

483 Heavy chain full length sequence (SEQ ID NO: 5349)

QVQLQESGPGLVKPSETLSLTCTVSGGSISSYYWSWIRQPPGKGLEWIGYIYYSGSTNYNPSLKSRVTISVDT
SKNQFSLKLSSVTAADTAVYYCARAPEEKSSEIGELVGWGWFDPWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVNHK
PSNTKVDKRVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPREPQ
VYTLPPSREEMTKNQVSLTCLVKGFYPSDIAVEWESNGQPENNYKTTPPVLDSDGSFFLYSKLTVDKSRWQ
QGNVFSCSVMHEALHNHYTQKSLSLSPGK

483 Light chain full length sequence (SEQ ID NO: 5350)

SYELTQPPSVSVSPGQTASIICSGDKLGDKYACWYQQKPGQSPVLVIYQDSKRPSGIPERFSGSNSGNTATLT
ISGTQAMDEADYYCQAWDSSTVVFGGGTKLTVLGQPKAAPSVTLFPPSSEELQANKATLVCLISDFYPGAV
TVAWKADSSPVKAGVETTTPSKQSNNKYAASSYLSLTPEQWKSHRSYSCQVTHEGSTVEKTVAPTECS

488 Heavy chain full length sequence (SEQ ID NO: 5351)

EVQLVESGGGLIQPGGSLRLSCAASGLTVSSNYMSWVRQAPGKGLEWVSVIYSGGSTYYADSVKGRFTISR
DNSKNTLYLQMNSLRAEDTAVYYCARSPYGGNSWGQGTLVTVSSASTKGPSVFPLAPSSKSTSGGTAALG
CLVKDYFPEPVTVSWNSGALTSGVHTFPAVLQSSGLYSLSSVVTVPSSSLGTQTYICNVNHKPSNTKVDKR
VEPKSCDKTHTCPPCPAPELLGGPSVFLFPPKPKDTLMISRTPEVTCVVVDVSHEDPEVKFNWYVDGVEVH
NAKTKPREEQYNSTYRVVSVLTVLHQDWLNGKEYKCKVSNKALPAPIEKTISKAKGQPREPQVYTLPPSRE

-continued

EMTKNQVSLTCLVKGFYPSDIAVEWESNGQPENNYKTTPPVLDSDGSFFLYSKLTVDKSRWQQGNVFSCS

VMHEALHNHYTQKSLSLSPGK

488 Light chain full length sequence (SEQ ID NO: 5352)

DIQMTQSPSSLSASVGDRVTITCQASQDISNYLNWYQQKPGKAPKLLIYDASNLETGVPSRFSGSGSGTDFT

FTISSLQPEDIATYYCQQYDNLPITFGQGTRLEIKRTVAAPSVFIFPPSDEQLKSG-
TASVVCLLNNFYPREAKV

QWKVDNALQSGNSQESVTEQDSKDSTYSLSSTLTLSKADYEKHKVYACEVTHQGLSSPVTKSFNRGEC

494 Heavy chain full length sequence (SEQ ID NO: 5353)

EVQLVESGGGLVQPGGSLRLSCAASGFTVSSNYMSWVRQAPGKGLEWVSVIYSGGSTFYADSVKGRFTISR

DNSKNTLYLQMNSLRAEDTAVYYCARDSGDQLLDYWGQGTLVTVSSASTKGPSVFPLAPSSKSTSGGTAAL

GCLVKDYFPEPVTVSWNSGALTSGVHTFPAVLQSSGLYSLSSVVTVPSSSLGTQTYICNVNHKPSNTKVD

KRVEPKSCDKTHTCPPCPAPELLGGPSVFLFPPKPKDTLMISRTPEVTCVVVDVSHEDPEVKFNWYVDGVE

VHNAKTKPREEQYNSTYRVVSVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGSFFLYSKLTVDKSRWQQGNVF

SCSVMHEALHNHYTQKSLSLSPGK

494 Light chain full length sequence (SEQ ID NO: 5354)

DIQLTQSPSFLSASVGDRVTITCRASQGISSYLAWYQQKPGKAPKLLIYAASTLQSGVPSRFSGSGSGTEFTL

TISSLQPEDFATYYCQQLNSYPPFTFGPGTKVDIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

506 Heavy chain full length sequence (SEQ ID NO: 5355)

QITLKESGPTLVKPTQTLTLTCTFSGFSLSTSGVGVGWIRQPPGKALEWLALIYWDDDKRYSPSLKSRLTITK

DTSKNQVVLTMTNMDPVDTATYYCAHHSLSSIFDYWGQGTLVTVSSASTKGPSVFPLAPSSKSTSGGTAAL

GCLVKDYFPEPVTVSWNSGALTSGVHTFPAVLQSSGLYSLSSVVTVPSSSLGTQTYICNVNHKPSNTKVDK

RVEPKSCDKTHTCPPCPAPELLGGPSVFLFPPKPKDTLMISRTPEVTCVVVDVSHEDPEVKFNWYVDGVEV

HNAKTKPREEQYNSTYRVVSVLTVLHQDWLNGKEYKCKVSNKALPAPIEKTISKAKGQPREPQVYTLPPSR

EEMTKNQVSLTCLVKGFYPSDIAVEWESNGQPENNYKTTPPVLDSDGSFFLYSKLTVDKSRWQQGNVFSC

SVMHEALHNHYTQKSLSLSPGK

506 Light chain full length sequence (SEQ ID NO: 5356)

QSALTQPASVSGSPGQSITISCTGTSSDVGDYNYVSWYQQHPGKAPKLMIYEVSNRPSGVSNRFSGSKSGNT

ASLTISGLQAEDEADYYCSSYTSSSTVFGGGTKLTVLGQPKAAPSVTLFPPSSEELQANKATLVCLISDFYPG

AVTVAWKADSSPVKAGVETTTPSKQSNNKYAASSYLSLTPEQWKSHRSYSCQVTHEGSTVEKTVAPTECS

540 Heavy chain full length sequence (SEQ ID NO: 5357)

EVQLVESGGGLVKPGGSLRLSCAASGFTFSNAWMSWVRQAPGKGLEWVGHIKSKTDGGTTDYAAPVKGR

FTISRDDSKNTLYLQMNSLKTEDTAVYYCTREPYYFDYWGQGTLVTVSSASTKGPSVFPLAPSSKSTSGGT

AALGCLVKDYFPEPVTVSWNSGALTSGVHTFPAVLQSSGLYSLSSVVTVPSSSLGTQTYICNVNHKPSNTK

VDKRVEPKSCDKTHTCPPCPAPELLGGPSVFLFPPKPKDTLMISRTPEVTCVVVDVSHEDPEVKFNWYVDG

VEVHNAKTKPREEQYNSTYRVVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPGK

-continued

540 Light chain full length sequence
(SEQ ID NO: 5358)
DIQMTQSPSTLSASVGDRVTITCRASQSISSWLAWYQQKPGKAPKLLIYKASSLESGVPSRFSGSGSGTEFTL

TISSLQPDDFATYYCQQYNSYRYTFGQGTKLEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

549 Heavy chain full length sequence
(SEQ ID NO: 5359)
EVQLVESGGGLIQPGGSLRLSCAASGLTVSSNYMSWVRQAPGKGLEWVSVIYSGGSTYYADSVKGRFTISR

DNSKNTLYLQMNSLRAEDTAVYYCARSPYGGNSWGQGTLVTVSSASTKGPSVFPLAPSSKSTSGGTAALG

CLVKDYFPEPVTVSWNSGALTSGVHTFPAVLQSSGLYSLSSVVTVPSSSLGTQTYICNVNHKPSNTKVDKR

VEPKSCDKTHTCPPCPAPELLGGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKTISKAKGQPREPQVYTLPPSRE

EMTKNQVSLTCLVKGFYPSDIAVEWESNGQPENNYKTTPPVLDSDGSFFLYSKLTVDKSRWQQGNVFSCS

VMHEALHNHYTQKSLSLSPGK

549 Light chain full length sequence
(SEQ ID NO: 5360)
DIQMTQSPSSLSASVGDRVTITCRTSQTIYNYLNWYQQKPGKAPKFLIYAASSFQNGVPSRFSGSGSGTDFTF

TISSLQPEDFATYYCQQGYSTPLTFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

553 Heavy chain full length sequence
(SEQ ID NO: 5361)
QVQLVQSGAEVKKPGASVKVSCKASGYTFTSYGISWVRQAPGQGLEWMGWISAYNGNTNYAQKLQGRV

TMTTDTSTSTAYMELRSLRSDDTAVYYCARDRGYAATFGVFDYWGQGTLVTVSSASTKGPSVFPLAPSSK

STSGGTAALGCLVKDYFPEPVTVSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQ

QGNVFSCSVMHEALHNHYTQKSLSLSPGK

553 Light chain full length sequence
(SEQ ID NO: 5362)
DIQMTQSPSSLSASVGDRVTITCRASQSISSYLNWYQQKPGKAPKLLISAASSLQSGVPSRFSGSGSGTDFTL

TISSLQPEDFATYYCQQSYSTAFTFGPGTKVDIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

555 Heavy chain full length sequence
(SEQ ID NO: 5363)
QVQLVQSGAEVKKPGSSVKVSCKASGGTFSNYAISWVRQAPGQGLEWIVIGRIIPILGIANYAQKFQGRVITT

ADKSTSTAYMELSSLKSEDTAVYYCARGYYEARHYYYYAMDVWGQGTAVTVSSASTKGPSVFPLAPSS

KSTSGGTAALGCLVKDYFPEPVTVSWNSGALTSGVHTFPAVLQSSGLYSLSSVVTVPSSSLGTQTYICNVNH

KPSNTKVDKRVEPKSQDKIHTCPPCPAPELLGGPSVFLEPPKPKDILMISKIPEVICVVVDVSHEDPEVKFN

WYVDGVEVHNAKTKPRELQYNSIYRVVSVLTVLHQDWLNGKEYKCKVSNKALPAPIEKTISKAKGQPRE

PQVYTLPPSREEMTKNQVSLTCLVKGFYPSDIAVEWESNGQPENNYKFTPPVLDSDGSFFLYSKLTVDKSR

WQQGNVESCSVMHEALHNRYTQKSLSLSPGK

555 Light chain full length sequence (SEQ ID NO: 5364)

DIQMTQSPSSLSASVGDRVTITCRASQSISSYLSWYQQKPGKAPKLLIYAASSLQSGVPSRFSGSGSGTDFTL

TITSLQPEDFATYYCQQSYSTPRTFGQGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

562 Heavy chain full length sequence (SEQ ID NO: 5365)

QVQLVESGGGVVQPGRSLRLSCAASGFTFSSYAMHWVRQAPGKGLEWVAVISYDGSNKYYADSVKGRFT

ISRDNSKNTLYLQMNSLRAEDTAVYYCARASSGGYQGPFDPWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

562 Light chain full length sequence (SEQ ID NO: 5366)

QSALTQPASVSGSPGQSITISCTGTSSDVGGYNYVSWYQQHPGKAPKLMIYDVSNRPSGVSNRFSGSKSGNT

ASLTISGLQAEDEADYYCSSYTSSSTLLYVFGTGTKVTVLGQPKAAPSVTLFPPSSEELQANKATLVCLISDF

YPGAVTVAWKADSSPVKAGVETTTPSKQSNNKYAASSYLSLTPEQWKSHRSYSCQVTHEGSTVEKTVAPT

ECS

851 Heavy chain full length sequence (SEQ ID NO: 5707)

QITLKESGPTLVKPTQTLTLTCTFSGFSLSTNGVGMGWIRQPPGKALEWLALIYWDDDQFYSPSLKSRLTIT

RDTSKNQVVLTMTNMDPVDTATYYCAQAFYESFGFYSWGQGTLVTVSSASTKGPSVFPLAPSSKSTSGGT

AALGCLVKDYFPEPVTVSWNSGALTSGVHTFPAVLQSSGLYSLSSVVTVPSSSLGTQTYICNVNHKPSNTK

VDKRVEPKSCDKTHTCPPCPAPELLGGPSVFLFPPKPKDTLMISRTPEVTCVVVDVSHEDPEVKFNWYVDG

VEVHNAKTKPREEQYNSTYRVVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPGK

851 Light chain full length sequence (SEQ ID NO: 5708)

NFMLTQPHSVSESPGKTVIISCTRSIGSIASNYVQWYQQRPGSAPTIVVFED-
NERPSGVPDRFSGSIDRSSNSA

SLTISGLKTEDEADYYCQSYDGSSELVFGGGTKLTVLGQPKAAPSVTLFPPSSEELQANKATLVCLISDFYPG

AVTVAWKADSSPVKAGVETTTPSKQSNNKYAASSYLSLTPEQWKSHRSYSCQVTHEGSTVEKTVAPTECS

894 Heavy chain full length sequence (SEQ ID NO: 5709)

QVQLVQSGAEVKKPGASVKVSCKVSGYTLPELSIHWVRQAPGKGLEWMGGFDPENAETIYTQKFQGRLT

MTEDTSTDTAYMELSSLRSEDTAMYYCATSFVLMPAALGDYSYYYGMDVWGQGTTVTVSSASTKGPSVF

PLAPSSKSTSGGTAALGCLVKDYFPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

894 Light chain full length sequence (SEQ ID NO: 5710)

DIVMTQTPLSSPVTLGQPASISCRSSQSLVHSDGNTYLSWLQQRPGQPPRLLIYKISNRFSGVPDRFSGSGAG

TDFTLKISRVEAEDVGVYYCMQATQFPLTFGGGTKVEIKRTVAAPSVFIFPPSDEQLKSGTASVVCLLNNFY

```
PREAKVQWKVDNALQSGNSQESVTEQDSKDSTYSLSSTLTLSKADYEKHKVYACEVTHQGLSSPVTKSFN

RGEC

896 Heavy chain full length sequence
                                                        (SEQ ID NO: 5711)
EVQLVESGGGVVQPGGSLRLSCAASGFTFDDYAMHWVRQVPGKGLEWVSLISGDGGSTYYADSVKGRFTI

SRDNSKNSLYVQMNSLRTEDTALYYCVKDRGGSGWDLNHYYYGMDVWGQGTTVTVSSASTKGPSVFPL

APSSKSTSGGTAALGCLVKDYFPEPVTVSWNSGALTSGVHTFPAVLQSSGLYSLSSVVTVPSSSLGTQTYIC

NVNHKPSNTKVDKRVEPKSCDKTHTCPPCPAPELLGGPSVFLFPPKPKDTLMISRTPEVTCVVVDVSHEDPE

VKFNWYVDGVEVHNAKTKPREEQYNSTYRVVSVLTVLHQDWLNGKEYKCKVSNKALPAPIEKTISKAKG

QPREPQVYTLPPSREEMTKNQVSLTCLVKGFYPSDIAVEWESNGQPENNYKTTPPVLDSDGSFFLYSKLTV

DKSRWQQGNVFSCSVMHEALHNHYTQKSLSLSPGK

896 Light chain full length sequence
                                                        (SEQ ID NO: 5712)
DIQLTQSPSFLSASVGDRVTVTCRASQGISSYLAWYQQKPGKAPKLLIYAAYTLQSGVPSRFSGSGSETEFTL

TISSLQPEDFATYYCQQVKSYPLTFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

923 Heavy chain full length sequence
                                                        (SEQ ID NO: 5713)
EVQLVESGGGVVRPGGSLRLSCAASGFIFDDYDMTWVRQAPGKGLEWVSGISWNGGNTGYADSVKGRFT

ISRDNAKNSLYLQMNSLRAEDTALYHCAVIMSPIPRYSGYDWAGGAFDIWGQGTMVTVSSASTKGPSVFP

LAPSSKSTSGGTAALGCLVKDYFPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

923 Light chain full length sequence
                                                        (SEQ ID NO: 5714)
SSELTQDPAVSVALGQTVRITCQGDSLRSYYASWYQQKPGQVPILVIYDKNNRPSGIPDRFSGSSSGNTASL

TITGAQAEDEADYYCNSRDSSGNAVVFGGGTKLTVLGQPKAAPSVTLFPPSSEELQANKATLVCLISDFYPG

AVTVAWKADSSPVKAGVETTTPSKQSNNKYAASSYLSLTPEQWKSHRSYSCQVTHEGSTVEKTVAPTECS

936 Heavy chain full length sequence
                                                        (SEQ ID NO: 5715)
EVQLVESGGGLVQPGRSLTLSCAGSGFTFDDYAMHWVRQAPGKGLEWVSGISWNSGSIGYADSVKGRFTI

SRDNAKNSLYLQMNSLRAEDTALYYCAKDVSYDSSGYYNNAFDIWGQGTMVTVSSASTKGPSVFPLAPSS

KSTSGGTAALGCLVKDYFPEPVTVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTPPVLDSDGSFFLYSKLTVDKSR

WQQGNVFSCSVMHEALHNHYTQKSLSLSPGK

936 Light chain full length sequence
                                                        (SEQ ID NO: 5716)
DIQLTQSPSFLSASVGDRVTITCRASQGISSYLAWYQQKPGKAPKLLIYAASTLQSGVPSRFSGSGSGTEFTL

TISSLQPEDFATYYCQQLYSYPVTFGQGTRLEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC
```

-continued

970 Heavy chain full length sequence
(SEQ ID NO: 5717)
EVQLVESGGGLVQPGGSLRLSCAASGFTFSSYWMSWVRQAPGKGLEWVANINKDGSEKYYVDSVKGRFT

ISRDNAKNSLYLQMNSLRAEDTAVYFCARDYRYFDWLLSQIDLEIDYFDYWGQGTLVTVSSASTKGPSVFP

LAPSSKSTSGGTAALGCLVKDYFPEPVTVSWNSGALTSGVHTFPAVLQSSGLYSLSSVVTVPSSSLGTQTYI

CNVNHKPSNTKVDKRVEPKSCDKTHTCPPCPAPELLGGPSVFLFPPKPKDTLMISRTPEVTCVVVDVSHEDP

EVKFNWYVDGVEVHNAKTKPREEQYNSTYRVVSVLTVLHQDWLNGKEYKCKVSNKALPAPIEKTISKAK

GQPREPQVYTLPPSREEMTKNQVSLTCLVKGFYPSDIAVEWESNGQPENNYKTTPPVLDSDGSFFLYSKLT

VDKSRWQQGNVFSCSVMHEALHNHYTQKSLSLSPGK

970 Light chain full length sequence
(SEQ ID NO: 5718)
DIQMTQSPSSLSASVGDRVTITCRASQSISSYLNWYQQKPGKAPKVLIYAASSLQSGVPSRFSGSGSGTDFTL

TISSLQPEDFATYYCQQSYSTPLTFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

1015 Heavy chain full length sequence
(SEQ ID NO: 5719)
EVQLVESGGGLVQPGGSLRLSCAASGFTFSSYWMHWVRQAPGKGLVWVSHINSDGSSTSYADSVKGRFTI

SRDNAKNTLYLQMNSLRAEDTAVYYCARGLRYFDLDVWGQGTTVTVSSASTKGPSVFPLAPSSKSTSGGT

AALGCLVKDYFPEPVTVSWNSGALTSGVHTFPAVLQSSGLYSLSSVVTVPSSSLGTQTYICNVNHKPSNTK

VDKRVEPKSCDKTHTCPPCPAPELLGGPSVFLFPPKPKDTLMISRTPEVTCVVVDVSHEDPEVKFNWYVDG

VEVHNAKTKPREEQYNSTYRVVSVLTVLHQDWLNGKEYKCKVSNKALPAPIEKTISKAKGQPREPQVYTL

PPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPGK

1015 Light chain full length sequence
(SEQ ID NO: 5720)
QSVLTQPPSVSEAPRQRVTISCSGSSSNIGNNAVNWYQQLPGKAPKLLIFYDDLLPSGVSDRFSGSKSGTSAS

LAISGLQSEDEADYYCAAWDDSLNGGVFGGGTKLTVLGQPKAAPSVTLFPPSSEELQANKATLVCLISDFY

PGAVTVAWKADSSPVKAGVETTTPSKQSNNKYAASSYLSLTPEQWKSHRSYSCQVTHEGSTVEKTVAPTE

CS

1036 Heavy chain full length sequence
(SEQ ID NO: 5721)
QVQLVQSGAEVKKPGSSVKVSCKASGGTLSSYTISWVRQAPGQGLEWMGRIIPILGIADYAQKFQGRVTIT

ADKSTTTAYMDLSSLGSEDTALYYCASAPKDWSSGFDYYYGMDVWGQGTMVTVSSASTKGPSVFPLAPS

SKSTSGGTAALGCLVKDYFPEPVTVSWNSGALTSGVHTFPAVLQSSGLYSLSSVVTVPSSSLGTQTYICNVN

HKPSNTKVDKRVEPKSCDKTHTCPPCPAPELLGGPSVFLFPPKPKDTLMISRTPEVTCVVVDVSHEDPEVKF

NWYVDGVEVHNAKTKPREEQYNSTYRVVSVLTVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVDKS

RWQQGNVFSCSVMHEALHNHYTQKSLSLSPGK

1036 Light chain full length sequence
(SEQ ID NO: 5722)
DIVMTQTPLSLSVTPGQPASISCKSSQSLLNSDGKTYLYWYLQKAGQPPQLLIYEVSNRFSGVPERFSGSGSG

TDFTLKISRVEAEDVGVYYCMQSVQLPPYTFGQGTKLEITRTVAAPSVFIFPPSDEQLKSGTASVVCLLNNF

YPREAKVQWKVDNALQSGNSQESVTEQDSKDSTYSLSSTLTLSKADYEKHKVYACEVTHQGLSSPVTKSF

NRGEC

-continued

1037 Heavy chain full length sequence (SEQ ID NO: 5723)
QITLKESGPTLVKPTQTLTLTCTFSGFSLSTSGVGVGWIRQPPGKALEWLALIYWDDDKRYSPSLKSRLTITK

DTSKNQVVLTMTNMDPVDTATYYCAHHTITRINDYWGQGTLVTVSSASTKGPSVFPLAPSSKSTSGGTAA

LGCLVKDYFPEPVTVSWNSGALTSGVHTFPAVLQSSGLYSLSSVVTVPSSSLGTQTYICNVNHKPSNTKVD

KRVEPKSCDKTHTCPPCPAPELLGGPSVFLFPPKPKDTLMISRTPEVTCVVVDVSHEDPEVKFNWYVDGVE

VHNAKTKPREEQYNSTYRVVSVLTVLHQDWLNGKEYKCKVSNKALPAPIEKTISKAKGQPREPQVYTLPP

SREEMTKNQVSLTCLVKGFYPSDIAVEWESNGQPENNYKTTPPVLDSDGSFFLYSKLTVDKSRWQQGNVF

SCSVMHEALHNHYTQKSLSLSPGK

1037 Light chain full length sequence (SEQ ID NO: 5724)
QSALTQPASVSGSPGQSITISCTATSSDVGAYNYVSWYQQHPGKAPKLMIYDVSKRPSGVSNRFSGSKSGNT

ASLTISGLQAEDEADYYCSSYTSSSTVFGGGTKLTVLGQPKAAPSVTLFPPSSEELQANKATLVCLISDFYPG

AVTVAWKADSSPVKAGVETTTPSKQSNNKYAASSYLSLTPEQWKSHRSYSCQVTHEGSTVEKTVAPTECS

1075 Heavy chain full length sequence (SEQ ID NO: 5725)
QVQLVQSGAEVKKPGASVKVSCKVSGYTLIELSMHWVRQAPGKGLEWMGGFDPEDGETIYAQKFQGRVT

MTEDTSTDTAYMELSSLRSEDTAVYYCATEWAYYGSGSYLGYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVNHKP

SNTKVDKRVEPKSCDKTHTCPPCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQ

QGNVFSCSVMHEALHNHYTQKSLSLSPGK

1075 Light chain full length sequence (SEQ ID NO: 5726)
EIVMTQSPATLSVSPGERATLSCRASQSVSSNLAWFQQKPGQAPRLLIYGASTRVTVIPARFSGSGSGTEFTL

TISSLQSEDFAVYYCQQYNNWPRTFGQGTKVEIKRTVAAPSVFIFPPSDEQLKSGTASVVCLLNNFYPREAK

VQWKVDNALQSGNSQESVTEQDSKDSTYSLSSTLTLSKADYEKHKVYACEVTHQGLSSPVTKSFNRGEC

1130 Heavy chain full length sequence (SEQ ID NO: 5727)
QVQLVQSGAEVKKPGSSVKVSCKASGGTFSSNTISWVRQAPGQGLEWMGRIIPLLGTVNYAQKFQGRVTIT

ADKSTTTAYMELSSLRSEDTAVYYCARDAGGITIFGVEHYYYYMDVWGKGTTVTVTSASTKGPSVFPLAP

SSKSTSGGTAALGCLVKDYFPEPVTVSWNSGALTSGVHTFPAVLQSSGLYSLSSVVTVPSSSLGTQTYICNV

NHKPSNTKVDKRVEPKSCDKTHTCPPCPAPELLGGPSVFLFPPKPKDTLMISRTPEVTCVVVDVSHEDPEVK

FNWYVDGVEVHNAKTKPREEQYNSTYRVVSVLTVLHQDWLNGKEYKCKVSNKALPAPIEKTISKAKGQP

REPQVYTLPPSREEMTKNQVSLTCLVKGFYPSDIAVEWESNGQPENNYKTTPPVLDSDGSFFLYSKLTVDK

SRWQQGNVFSCSVMHEALHNHYTQKSLSLSPGK

1130 Light chain full length sequence (SEQ ID NO: 5728)
EIVLTQSPGTLSLSPGERATLSCRASQSVSSSHLAWYQQKPGQAPRLLIYDASSRATGIPDRFSGSGSGTDFT

LTISRLEPEDFAVYYCQQYGSSPPMYTFGQGTKLEIKRTVAAPSVFIFPPSDEQLKSGTASVVCLLNNFYPRE

AKVQWKVDNALQSGNSQESVTEQDSKDSTYSLSSTLTLSKADYEKHKVYACEVTHQGLSSPVTKSFNRGE

C

-continued

1135 Heavy chain full length sequence
(SEQ ID NO: 5729)
EVQLVESGGGLVQPGRSLRLSCAASGLTFEDYAMHWVRQVPGKGLEWVSGISWNSGTIGYADSVKGRFIIS
RDNAKNSLYLQMRSLRAEDTALYYCAKDVGFGELLYYAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNHKPS
NTKVDKRVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREPQV
YTLPPSREEMTKNQVSLTCLVKGFYPSDIAVEWESNGQPENNYKTTPPVLDSDGSFFLYSKLTVDKSRWQQ
GNVFSCSVMHEALHNHYTQKSLSLSPGK 1135 Light chain full length sequence
(SEQ ID NO: 5730)
QSALTQPASVSGSPGQSITISCTGTSSDVGGYNYVSWYQQHPGKAPKLMIYDVSNRPSGVSNRFSGSKSGNT
ASLTISGLQAEDEADYYCSSYTSSSTVVFGGGTKLTVLGQPKAAPSVTLFPPSSEELQANKATLVCLISDFYP
GAVTVAWKADSSPVKAGVETTTPSKQSNNKYAASSYLSLTPEQWKSHRSYSCQVTHEGSTVEKTVAPTEC
S 1139 Heavy chain full length sequence
(SEQ ID NO: 5731)
QVQLVQSGAEVKKPGASVKVSCKASGYTFSSYEINWVRQATGQGLEWMGRMTLNSGNTGYAQNFQGRV
TMTRDTSISTAYMELSGLRSEDTAVYYCARMRSGWPTHGRPDDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNVNH
KPSNTKVDKRVEPKSCDKTHTCPPCPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKAKGQPRE
PQVYTLPPSREEMTKNQVSLTCLVKGFYPSDIAVEWESNGQPENNYKTTPPVLDSDGSFFLYSKLTVDKSR
WQQGNVFSCSVMHEALHNHYTQKSLSLSPGK 1139 Light chain full length sequence
(SEQ ID NO: 5732)
QSVLTQPPSASGTPGQRVTISCSGSNSNIGSYTVNWYQQLPGTAPKLLIYGNNQRPSGVPDRFSGSKSGTSAS
LAISGLQSEDEADYYCLAWDDSRNGLVFGGGTKLTVLGQPKAAPSVTLFPPSSEELQANKATLVCLISDFYP
GAVTVAWKADSSPVKAGVETTTPSKQSNNKYAASSYLSLTPEQWKSHRSYSCQVTHEGSTVEKTVAPTEC
S 1149 Heavy chain full length sequence
(SEQ ID NO: 5733)
HQVQLVQSGAEVKKPGASVKVSCKASGYTFASYDINWVRQATGQGPEWMGWMIPNIGNTGYAQKFQGR
VTMTRNTSISTAYMELSSLTSEDTAVYYCARVSRLFNDFGLRHEAPVDFWGQGTRVTVSSASTKGPSVFPL
APSSKSTSGGTAALGCLVKDYFPEPVTVSWNSGALTSGVHTFPAVLQSSGLYSLSSVVTVPSSSLGTQTYIC
NVNHKPSNTKVDKRVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK 1149 Light chain full length sequence
(SEQ ID NO: 5734)
QSVLTQPPSVSGAPGQRVTISCTGSSSNIGAGYDVHWYQQLPGTAPKLLIYGYSSRPSGVPDRFSGSKSGTS
ASLAITGLQAEDEADYYCQSYDSSLSVLFGGGTKLTVLGQPKAAPSVTLFPPSSEELQANKATLVCLISDFY
PGAVTVAWKADSSPVKAGVETTTPSKQSNNKYAASSYLSLTPEQWKSHRSYSCQVTHEGSTVEKTVAPTE
CS -continued 1404 Heavy chain full length sequence
(SEQ ID NO: 5735)
QITLKESGPTLVKPTQTLTLTCTFSGFSLSISGVGVGWLRQPPGKALEWLALIYWDDDKRYSPSLKSRLTISK

DTSKNQVVLKMTNIDPVDTATYYCAHHSISTIFDHWGQGTLVTVSSASTKGPSVFPLAPSSKSTSGGTAALG

CLVKDYFPEPVTVSWNSGALTSGVHTFPAVLQSSGLYSLSSVVTVPSSSLGTQTYICNVNHKPSNTKVDKR

VEPKSCDKTHTCPPCPAPELLGGPSVFLFPPKPKDTLMISRTPEVTCVVVDVSHEDPEVKFNWYVDGVEVH

NAKTKPREEQYNSTYRVVSVLTVLHQDWLNGKEYKCKVSNKALPAPIEKTISKAKGQPREPQVYTLPPSRE

EMTKNQVSLTCLVKGFYPSDIAVEWESNGQPENNYKTTPPVLDSDGSFFLYSKLTVDKSRWQQGNVFSCS

VMHEALHNHYTQKSLSLSPGK

1404 Light chain full length sequence
(SEQ ID NO: 5736)
QSALTQPASVSGSPGQSITISCTATSSDVGDYNYVSWYQQHPGKAPKLMIFEVSDRPSGISNRFSGSKSGNT

ASLTISGLQAEDEADYYCSSYTTSSAVFGGGTKLTVLGQPKAAPSVTLFPPSSEELQANKATLVCLISDFYPG

AVTVAWKADSSPVKAGVETTTPSKQSNNKYAASSYLSLTPEQWKSHRSYSCQVTHEGSTVEKTVAPTECS

1444 Heavy chain full length sequence
(SEQ ID NO: 5737)
QVQLVQSGAEVKKPGASVKVSCKASGYTFTAYYMHWVRQAPGQGLEWMGWINPNSDDTNYAQKFQGR

VTMTRDTSISTAYMELSRLRSDDTAVYYCAREEGVFTIGDRYFDLWGRGTLVSVSSASTKGPSVFPLAPSSK

STSGGTAALGCLVKDYFPEPVTVSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQ

QGNVFSCSVMHEALHNHYTQKSLSLSPGK

1444 Light chain full length sequence
(SEQ ID NO: 5738)
QTVVTQEPSFSVSPGGTVTLTCGLSSGSVSTSYYPSWYQQTPGQAPRTLIYNTNTRSSGVPDRFSGSILGNKA

ALTITGAQADDESDYYCVLYMGSGIWVFGGGTKLTVLGQPKAAPSVTLFPPSSEELQANKATLVCLISDFY

PGAVTVAWKADSSPVKAGVETTTPSKQSNNKYAASSYLSLTPEQWKSHRSYSCQVTHEGSTVEKTVAPTE

CS

1495 Heavy chain full length sequence
(SEQ ID NO: 5739)
QVQLVESGGGVVQPGRSLRLSCTASGFTFSSYAMHWVRQAPGKGLEWVAVISYDGNNKYYGDSVKGRFT

ISRDNSKNTLYLQMNSLRAEDTAVYYCAKGADTPHYSGYHFLSVGYYFYGMDVWGQGTTVTVSSASTKG

PSVFPLAPSSKSTSGGTAALGCLVKDYFPEPVTVSWNSGALTSGVHTFPAVLQSSGLYSLSSVVTVPSSSLGT

QTYICNVNHKPSNTKVDKRVEPKSCDKTHTCPPCPAPELLGGPSVFLFPPKPKDTLMISRTPEVTCVVVDVS

HEDPEVKFNWYVDGVEVHNAKTKPREEQYNSTYRVVSVLTVLHQDWLNGKEYKCKVSNKALPAPIEKTI

SKAKGQPREPQVYTLPPSREEMTKNQVSLTCLVKGFYPSDIAVEWESNGQPENNYKTTPPVLDSDGSFFLY

SKLTVDKSRWQQGNVFSCSVMHEALHNHYTQKSLSLSPGK

1495 Light chain full length sequence
(SEQ ID NO: 5740)
DIQMTQSPSSLSASVGDRVTITCRASQSISYYLNWYQQKPGKAPQLLIYAASSLQSGVPSRFSGSRSGTDFTL

TISSLQPEDFATYYCQQSYSTPFTFGPGTKVDIKRTVAAPSVFIFPPSDEQLKSGTASVVCLLNNFYPREAKV

QWKVDNALQSGNSQESVTEQDSKDSTYSLSSTLTLSKADYEKHKVYACEVTHQGLSSPVTKSFNRGEC

1538 Heavy chain full length sequence
(SEQ ID NO: 5741)
EVQLLESGGGLVQPGGSLRLSCAASGFTFSSYAMSWVRQAPGKGLEWVSGISDSGGSTYYADYVKGRFTIS

RDNSKDTLYLQMNSLRAEDTAVYYCAKDRGNEYALTHYYYYAMDVWGQGTTVTVSSASTKGPSVFPLA

-continued
```
PSSKSTSGGTAALGCLVKDYFPEPVTVSWNSGALTSGVHTFPAVLQSSGLYSLSSVVTVPSSSLGTQTYICN

VNHKPSNTKVDKRVEPKSCDKTHTCPPCPAPELLGGPSVFLFPPKPKDTLMISRTPEVTCVVVDVSHEDPEV

KFNWYVDGVEVHNAKTKPREEQYNSTYRVVSVLTVLHQDWLNGKEYKCKVSNKALPAPIEKTISKAKGQ

PREPQVYTLPPSREEMTKNQVSLTCLVKGFYPSDIAVEWESNGQPENNYKTTPPV the listed residues. In some embodiments, the epitope is determined by X-ray crystallography.

Also provided herein are antibodies that bind SARS-CoV-2 Spike protein, wherein the antibodies bind an epitope comprising one or more of the following residues of SARS-CoV-2 Spike protein: R403, D405, R408, Q409, T415, G416, K417, D420, Y421, Y453, L455, F456, R457, K458, 5459, N460, Y473, Q474, A475, G476, F486, N487, Y489, Q493, S494, Y495, G496, Q498, T500, N501, G502, Y505, wherein the amino acid residue positions correspond to SEQ ID NO: 5317. In some embodiments, the epitope comprises two or more (e.g., 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32) of the listed residues. In some embodiments, the epitope comprises three or more of the listed residues. In some embodiments, the epitope comprises four or more of the listed residues. In some embodiments, the epitope comprises five or more of the listed residues. In some embodiments, the epitope is determined by X-ray crystallography.

Also provided herein are antibodies that bind SARS-CoV-2 Spike protein, wherein the antibodies bind an epitope comprising one or more of the following residues of SARS-CoV-2 Spike protein: R403, T415, G416, K417, D420, Y421, L455, F456, R457, K458, 5459, N460, Y473, Q474, A475, G476, 5477, F486, N487, Y489, N501, G502, Y505, wherein the amino acid residue positions correspond to SEQ ID NO: 5317. In some embodiments, the epitope comprises two or more (e.g., 2, 3, 4, 5, 6, 7, 8, 9, 10, 11, 12, 13, 14, 15, 16, 17, 18, 19, 20, 21, 22, 23) of the listed residues. In some embodiments, the epitope comprises three or more of the listed residues. In some embodiments, the epitope comprises four or more of the listed residues. In some embodiments, the epitope comprises five or more of the listed residues. In some embodiments, the epitope is determined by X-ray crystallography.

The term "epitope" refers to the amino acid residues, of an antigen, that are bound by an antibody. An epitope can be a linear epitope, a conformational epitope, or a hybrid epitope. An epitope can be determined according to different experimental techniques, also called "epitope mapping techniques." It is understood that the determination of an epitope may vary based on the different epitope mapping techniques used and may also vary with the different experimental conditions used, e.g., due to the conformational changes or cleavages of the antigen induced by specific experimental conditions. Epitope mapping techniques are known in the art (e.g., Rockberg and Nilvebrant, *Epitope Mapping Protocols: Methods in Molecular Biology*, Humana Press, 3rd ed. 2018), including, but not limited to, X-ray crystallography, nuclear magnetic resonance (NMR) spectroscopy, electron microscopy, site-directed mutagenesis, species swap mutagenesis, alanine-scanning mutagenesis, hydrogen-deuterium exchange (HDX), and cross-blocking assays.

In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof is selected from an antibody or antigen-binding fragment described herein. In some embodiments, provided herein are compositions (e.g., pharmaceutical compositions) comprising two or three anti-SARS-CoV-2 antibodies or antigen-binding fragments thereof described herein. In some embodiments, provided herein are compositions (e.g., pharmaceutical compositions) comprising two or three anti-SARS-CoV-2 antibodies selected from antibodies 258 to 577 and 589 to 1587. In some embodiments, provided herein are compositions (e.g., pharmaceutical compositions) comprising two or three anti-SARS-CoV-2 antibodies, wherein at least one of the antibodies neutralize SARS-CoV-2. In some embodiments, provided herein are compositions (e.g., pharmaceutical compositions) comprising two or three anti-SARS-CoV-2 antibodies selected from antibodies 292, 309, 364, 373, 388, 408, 414, 417, 419, 442, 445, 447, 462, 479, 481, 483, 488, 494, 506, 540, 549, 553, 555, 562, 851, 894, 896, 923, 936, 970, 1015, 1036, 1037, 1075, 1130, 1135, 1139, 1149, 1404, 1444, 1495, 1538, and 1585.

In some embodiments, provided herein are compositions (e.g., pharmaceutical compositions) comprising two or three anti-SARS-CoV-2 antibodies, wherein at least one antibody or antigen-binding fragment thereof blocks SARS-CoV-2 binding to ACE2. In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof is selected from antibodies 292, 373, 408, 417, 447, 479, 481, 483, 488, 494, 506, 549, 553, 555, and 1404.

In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof binds the RBD of the SARS-CoV-2 S protein. In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof is an antibody selected from 292, 447, 481, 488, 494, 506, 549, 553, 555, and 1404. In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody is 555. In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody comprises a heavy chain comprising SEQ ID NO: 5363 and a light chain comprising SEQ ID NO: 5364. In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody is 1404. In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody comprises a heavy chain comprising SEQ ID NO: 5727 and a light chain comprising SEQ ID NO: 5728.

In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof binds the N-terminal domain (NTD) of the SARS-CoV-2 S protein. In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof is an antibody selected from antibodies 417, 419, and 479.

In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof binds the S2 domain/subunit of the SARS-CoV-2 S protein. In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof is an antibody selected from antibodies 309, 364, 373, 388, 442, 462, 540, and 562.

In some embodiments, provided herein are compositions (e.g., pharmaceutical compositions) comprising two or three anti-SARS-CoV-2 antibodies or antigen-binding fragments thereof that bind different epitopes of the SARS-CoV-2 S protein. In some embodiments, provided herein are compositions (e.g., pharmaceutical compositions) comprising a first anti-SARS-CoV-2 antibody or antigen-binding fragment thereof that binds a first epitope in the receptor-binding domain (RBD) of the SARS-CoV-2 S protein, and a second anti-SARS-CoV-2 antibody or antigen-binding fragment thereof that binds a second epitope of the SARS-CoV-2 S protein, wherein the second epitope is different from the first epitope.

Other suitable anti-SARS-CoV-2 antibodies that can be used in the composition include the antibodies described in Shi et al., "A human neutralizing antibody targets the receptor binding site of SARS-CoV-2." Nature 584, 120-124 (2020), e.g., CB6 or CA1 According to the authors, the sequences of CA1 and CB6 antibodies have been deposited in GenBank with the accession codes MT470194-MT470197, with MT470194 and MT470195 encoding the light and heavy chain of CA1; and MT470196 and MT470197 encoding the light and heavy chain of CB6.

In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody is an anti-SARS-CoV-2 antibody described herein, and the other antibody is CA1 or CB6. In some embodiments, provided herein are compositions (e.g., pharmaceutical compositions) comprising two or three anti-SARS-CoV-2 antibodies or antigen-binding fragments thereof, wherein at least one of the anti-SARS-CoV-2 antibody is 555, and the other antibody is CB6. 555 is also known as bamlanivimab and CB6 is also known as etesevimab.

In some embodiments, provided herein are compositions (e.g., pharmaceutical compositions) comprising two or three anti-SARS-CoV-2 antibodies or antigen-binding fragments thereof, wherein at least one antibody or antigen-binding fragment thereof binds the RBD of the SARS-CoV-2 S protein, and at least one antibody or antigen-binding fragment thereof binds the NTD or S2 domain of the SARS-CoV-2 S protein.

In some embodiments, provided herein are compositions (e.g., pharmaceutical compositions) comprising two or three anti-SARS-CoV-2 antibodies or antigen-binding fragments thereof that are both ACE2-blocking and bind to an epitope in the receptor-binding domain (RBD) or the N-terminal domain (NTD) of the SARS-CoV-2 S protein. In particular embodiments, at least one antibody or antigen-binding fragment thereof comprises: (i) three CDRs in the VH set forth as SEQ ID NO: 729 and three CDRs in the VL set forth as SEQ ID NO: 730; (ii) three CDRs in the VH set forth as SEQ ID NO: 779 and three CDRs in the VL set forth as SEQ ID NO: 780; (iii) three CDRs in the VH set forth as SEQ ID NO: 1039 and three CDRs in the VL set forth as SEQ ID NO: 1040; (iv) three CDRs in the VH set forth as SEQ ID NO: 1107 and three CDRs in the VL set forth as SEQ ID NO: 1108; (v) three CDRs in the VH set forth as SEQ ID NO: 1121 and three CDRs in the VL set forth as SEQ ID NO: 1122; (vi) three CDRs in the VH set forth as SEQ ID NO: 1133 and three CDRs in the VL set forth as SEQ ID NO: 1134; (vii) three CDRs in the VH set forth as SEQ ID NO: 1157 and three CDRs in the VL set forth as SEQ ID NO: 1158; (viii) three CDRs in the VH set forth as SEQ ID NO: 1243 and three CDRs in the VL set forth as SEQ ID NO: 1244; (ix) three CDRs in the VH set forth as SEQ ID NO: 1251 and three CDRs in the VL set forth as SEQ ID NO: 1252; (x) three CDRs in the VH set forth as SEQ ID NO: 1255 and three CDRs in the VL set forth as SEQ ID NO: 1256; (xi) three CDRs in the VH set forth as SEQ ID NO: 3421 and three CDRs in the VL set forth as SEQ ID NO: 3422; (xii) three CDRs in the VH set forth as SEQ ID NO: 3605 and three CDRs in the VL set forth as SEQ ID NO: 3606; (xiii) three CDRs in the VH set forth as SEQ ID NO: 3649 and three CDRs in the VL set forth as SEQ ID NO: 3650; or (xiv) three CDRs in the VH set forth as SEQ ID NO: 4949 and three CDRs in the VL set forth as SEQ ID NO: 4950, wherein the CDRs are defined by Kabat, Chothia, MacCallum, or North numbering.

In other embodiments, at least one antibody or antigen-binding fragment thereof that is both ACE2-blocking and binds to an epitope in the receptor-binding domain (RBD) or the N-terminal domain (NTD) of the SARS-CoV-2 S protein comprises: (i) the VH set forth as SEQ ID NO: 729 and the VL set forth as SEQ ID NO: 730; (ii) the VH set forth as SEQ ID NO: 779 and the VL set forth as SEQ ID NO: 780; (iii) the VH set forth as SEQ ID NO: 1039 and the VL set forth as SEQ ID NO: 1040; (iv) the VH set forth as SEQ ID NO: 1107 and the VL set forth as SEQ ID NO: 1108; (v) the VH set forth as SEQ ID NO: 1121 and the VL set forth as SEQ ID NO: 1122; (vi) the VH set forth as SEQ ID NO: 1133 and the VL set forth as SEQ ID NO: 1134; (vii) the VH set forth as SEQ ID NO: 1157 and the VL set forth as SEQ ID NO: 1158; (viii) the VH set forth as SEQ ID NO: 1243 and the VL set forth as SEQ ID NO: 1244; (ix) the VH set forth as SEQ ID NO: 1251 and the VL set forth as SEQ ID NO: 1252; (x) the VH set forth as SEQ ID NO: 1255 and the VL set forth as SEQ ID NO: 1256; (xi) the VH set forth as SEQ ID NO: 3421 and the VL set forth as SEQ ID NO: 3422; (xii) the VH set forth as SEQ ID NO: 3605 and the VL set forth as SEQ ID NO: 3606; (xiii) the VH set forth as SEQ ID NO: 3649 and the VL set forth as SEQ ID NO: 3650; or (xiv) the VH set forth as SEQ ID NO: 4949 and the VL set forth as SEQ ID NO: 4950.

In particular embodiments, anti-coronavirus antibodies (e.g., anti-SARS-CoV-2 antibodies) are neutralizing antibodies. In still other embodiments, the anti-coronavirus antibodies (e.g., anti-SARS-CoV-2 antibodies) are depleting antibodies. Moreover, as with the aforementioned fusion constructs, the anti-coronavirus antibodies (e.g., anti-SARS-CoV-2 antibodies) may be conjugated, linked, or otherwise associated with selected cytotoxic agents, polymers, biological response modifiers or the like to provide passive immunotherapy with various (and optionally multiple) mechanisms of action.

Donors who have been infected with (and have recovered from) SARS-CoV-2 are an ideal source of immune cells to discover, test, develop and manufacture antibodies as therapeutic treatments, prophylactic countermeasures, and diagnostic reagents to rapidly address emerging and recurring viral threats. Such antibodies can be discovered from a blood sample drawn from a donor that has been infected with SARS-CoV-2, a minimum of 2 weeks, e.g., a minimum of 7-8 weeks, prior to the blood draw. As such, the earliest confirmed patients, and even index patients can be a source of therapeutic, prophylactic, and diagnostic antibodies, using a minimally-invasive blood draw. The risk of viral escape from antigenic drift can be mitigated by surveillance of the infected population and identification of cross-reactive antibodies that recognize several viral strains. However, a rapid response that significantly shortens the drug discovery process, encompassing discovery, testing and manufacture of therapeutic, prophylactic, and diagnostic antibodies from index or early patients is key to quickly preventing emerging viral threats from becoming a threat to global health, and financial and political stability.

Those skilled in the art will appreciate that anti-coronavirus antibodies (e.g., anti-SARS-CoV-2 antibodies) may be used in conjugated or unconjugated form. That is, the anti-coronavirus antibody (e.g., anti-SARS-CoV-2 antibody) may be associated with or conjugated to (e.g., covalently or non-covalently) pharmaceutically active compounds, biological response modifiers, diagnostic moieties, or biocompatible modifiers. In this respect it will be understood that such conjugates may comprise peptides, polypeptides, proteins, fusion proteins, nucleic acid molecules, small molecules, mimetic agents, synthetic drugs, inorganic molecules, organic molecules, and radioisotopes. Moreover, a conjugate may be covalently or non-covalently linked to the anti-coronavirus antibody (e.g., anti-SARS-CoV-2 antibody) in various molar ratios depending, at least in part, on the method used to effect the conjugation.

As used herein, the term "antibody" or "immunoglobulin" are used interchangeably and in the broadest sense and cover both intact molecules and immunologically-reactive fragments thereof. These terms cover, for example, synthetic antibodies, monoclonal antibodies, oligoclonal or polyclonal antibodies, multiclonal antibodies, recombinantly produced antibodies, intrabodies, multispecific antibodies, bispecific antibodies, monovalent antibodies, multivalent antibodies, human antibodies, humanized antibodies, chimeric antibodies, CDR-grafted antibodies, primatized antibodies, Fab fragments, F(ab') fragments, F(ab')$_2$ fragments, F(ab)c fragments, single-chain FvFcs (scFvFc), single-chain Fvs (scFv), Dabs, nanobodies, anti-idiotypic (anti-Id) antibodies, and any other immunologically-reactive/antigen-binding fragments thereof.

Antibodies are grouped into five distinct classes that can be distinguished biochemically and, depending on the amino acid sequence of the constant domain of their heavy chains, can readily be assigned to the appropriate class. For historical reasons, the major classes of intact antibodies are termed IgA, IgD, IgE, IgG, and IgM. In humans, the IgG and IgA classes may be further divided into recognized subclasses (isotypes), i.e., IgG1, IgG2, IgG3, IgG4, IgA1, and IgA2 depending on structure and certain biochemical properties. It will be appreciated that the IgG isotypes in humans are named in order of their abundance in serum with IgG1 being the most abundant.

While all five classes of antibodies (i.e., IgA, IgD, IgE, IgG, and IgM) and all isotypes (i.e., IgG1, IgG2, IgG3, IgG4, IgA1, and IgA2), as well as variations thereof, are within the scope of the present disclosure, preferred embodiments belonging to the IgG class are discussed in some detail solely for the purposes of illustration. For example, in some embodiments, the anti-coronavirus antibodies (e.g., anti-SARS-CoV-2 antibodies) described herein have IgG1 isotype. It will be understood that such disclosure is, however, merely demonstrative of exemplary compositions and methods and is not in any way limiting.

In this respect, human IgG immunoglobulins comprise two identical light polypeptide chains of molecular weight approximately 23,000 Daltons, and two identical heavy chains of molecular weight 53,000-70,000 depending on the isotype. Heavy-chain constant domains that correspond to the different classes of antibodies are denoted by the corresponding lower case Greek letter α, δ, ε, γ, and μ, respectively. The light chains of the antibodies from any vertebrate species can be assigned to one of two clearly distinct types, called kappa (κ) and lambda (λ), based on the amino acid sequences of their constant domains. Those skilled in the art will appreciate that the subunit structures and three-dimensional configurations of different classes of immunoglobulins are well known.

The four chains are joined by disulfide bonds in a "Y" configuration wherein the light chains bracket the heavy chains starting at the mouth of the "Y" and continuing through the variable region to the dual ends of the "Y". Each light chain is linked to a heavy chain by one covalent disulfide bond while two disulfide linkages in the hinge region join the heavy chains. The respective heavy and light chains also have regularly spaced intrachain disulfide bridges the number of which may vary based on the isotype of IgG.

Each heavy chain has at one end a variable region ($V_H$) followed by a number of constant regions. Each light chain has a variable region at one end ($V_L$) and a constant region at its other end; the constant region of the light chain is aligned with the first constant region of the heavy chain, and the light chain variable region is aligned with the variable region of the heavy chain. The variable regions of both the light ($V_L$) and heavy ($V_H$) chain portions determine antigen recognition and specificity. Conversely, the constant regions of the light chain ($C_L$) and the heavy chain ($C_H1$, $C_H2$ or $C_H3$) confer and regulate important biological properties such as secretion, transplacental mobility, circulation half-life, complement binding, and the like. By convention, the numbering of the constant region regions increases as they become more distal from the antigen binding site or amino-terminus of the antibody. Thus, the amino or N-terminus of the antibody comprises the variable region and the carboxy or C-terminus comprises the constant region. Thus, the $C_H3$ and $C_L$ regions actually comprise the carboxy-terminus of the heavy and light chain, respectively.

Portions of the variable regions of both the heavy chain and light chain differ extensively in sequence among immunoglobulins and these hypervariable sites largely define the binding and specificity of a particular antibody. These hypervariable sites manifest themselves in three segments, known as complementarity determining regions (CDRs). The more highly conserved portions of variable regions flanking the CDRs are termed framework regions (FRs). More specifically, in naturally occurring monomeric IgG antibodies, the six CDRs present on each arm of the antibody are short, non-contiguous sequences of amino acids that are specifically positioned to form the antigen-binding site as the antibody assumes its three-dimensional configuration in vivo or in vitro. CDRs encompass amino acid residues identified using any sequence or structure-based method or nomenclature system known in the art and as described below.

By way of example, CDRs may be defined using the nomenclature described by Kabat et al. (1991, NIH Publication 91-3242, National Technical Information Service, Springfield, Va.), specifically, residues 31-35 (CDR-H1), 50-65 (CDR-H2), and 95-102 (CDR-H3) in the heavy chain variable region and residues 24-34 (CDR-L1), 50-56 (CDR-L2), and 89-97 (CDR-L3) in the light chain variable region.

By way of example, CDRs may also be defined using the nomenclature described by Chothia et al. (*J. Mol. Biol.* 196:901-917 (1987); *Nature* 342, pp. 877-883 (1989)), specifically, residues 26-32 (CDR-H1), 50-58 (CDR-H2), and 95-102 (CDR-H3) in the heavy chain variable region and residues 23-34 (CDR-L1), 50-56 (CDR-L2), and 89-97 (CDR-L3) in the light chain variable region.

By way of example, CDRs may also be defined using the nomenclature described by MacCallum et al. (*J. Mol. Biol.* 262:732-745 (1996), specifically, residues 30-35 (CDR-H1), 47-58 (CDR-H2), and 93-101 (CDR-H3) in the heavy chain variable region and residues 30-36 (CDR-L1), 46-55 (CDR-L2), and 89-96 (CDR-L3) in the light chain variable region.

By way of example, CDRs may also be defined using the nomenclature described by North (North et al., "A New Clustering of Antibody CDR Loop Conformations", *J. Mol. Biol.*, 406, 228-256 (2011)). In some embodiments, CDRs may also be defined using a combination of different nomenclatures, e.g., a hybrid of Kabat and North.

CDRs vary considerably from antibody to antibody (and by definition will not exhibit homology with the Kabat consensus sequences). Maximal alignment of framework residues frequently requires the insertion of spacer residues in the numbering system, to be used for the Fv region. In addition, the identity of certain individual residues at any given Kabat site number may vary from antibody chain to antibody chain due to interspecies or allelic divergence.

One skilled in the art could readily define, identify derive and/or enumerate the CDRs as defined by Kabat et al., Chothia et al. or MacCallum et al. for each respective antibody heavy and light chain sequence set forth herein. Accordingly, each of the subject CDRs and antibodies comprising CDRs defined by all such nomenclature are expressly included within the scope of the instant disclosure.

The framework regions comprise the remainder of the heavy and light chain variable regions and are thus comprised of a non-contiguous sequence between about 100-120 amino acids in length. For example, using the nomenclature of Kabat et al., framework region 1 corresponds to the region of the variable region encompassing amino acids 1-30; framework region 2 corresponds to the region of the variable region encompassing amino acids 36-49; framework region 3 corresponds to the region of the variable region encompassing amino acids 66-94, and framework region 4 corresponds to the region of the variable region from amino acids 103 to the end of the variable region. Similarly, using the definition of CDRs by Chothia et al. (e.g., CDR-L1 23-34, CDR-L2 50-56, CDR-L3 89-97; CDR-H1 26-32, CDR-H2 50-58, CDR-H3 95-102) or McCallum et al., the framework region boundaries are separated by the respective CDR termini as described above.

The framework regions show less inter-molecular variability in amino acid sequence and largely adopt a β-sheet conformation and the CDRs form loops which connect, and in some cases form part of, the β-sheet structure. Thus, these framework regions act to form a scaffold that provides for positioning the six CDRs in correct orientation by interchain, non-covalent interactions. The antigen-binding site formed by the positioned CDRs defines a surface complementary to the epitope on the immunoreactive antigen. This complementary surface promotes the non-covalent binding of the antibody to the immunoreactive antigen epitope.

All or part of the heavy and light chain variable regions may be recombined or engineered using standard recombinant and expression techniques to provide improve one or more properties of the resultant antibody. That is, the heavy or light chain variable region from a first antibody (or any portion thereof) may be mixed and matched with any selected portion of the heavy or light chain variable region from a second antibody. For example, in one embodiment, the entire light chain variable region comprising the three light chain CDRs of a first antibody may be paired with the entire heavy chain variable region comprising the three heavy chain CDRs of a second antibody. Moreover, in other embodiments, individual heavy and light chain CDRs derived from various antibodies may be mixed and matched to provide the desired antibody having optimized characteristics. Thus, an exemplary antibody may comprise three light chain CDRs from a first antibody, two heavy chain CDRs derived from a second antibody and a third heavy chain CDR from a third antibody.

With the aforementioned structural considerations in mind, those skilled in the art will appreciate that the antibodies of the present invention may comprise any one of a number of functional embodiments. In this respect, compatible antibodies may comprise any immunoreactive antibody (as the term is defined herein) that provides the desired physiological response in a subject. While any of the disclosed antibodies may be used in conjunction with the present teachings, certain embodiments of the invention will comprise chimeric, humanized, or human monoclonal antibodies or immunoreactive fragments thereof. Yet other embodiments may, for example, comprise homogeneous or heterogeneous multimeric constructs, Fc variants and conjugated or glycosylationally-altered antibodies. Moreover, it will be understood that such configurations are not mutually exclusive and that compatible individual antibodies may comprise one or more of the functional aspects disclosed herein. For example, a compatible antibody may comprise a single chain diabody with humanized variable regions or a fully human full length IgG3 antibody with Fc modifications that alter the glycosylation pattern to modulate serum half-life. Other exemplary embodiments are readily apparent to those skilled in the art and may easily be discernable as being within the scope of the invention.

Antibodies produced by naive libraries (either natural or synthetic) can be of moderate affinity ($K_a$ of about $10^6$ to $10^7$ $M^{-1}$), but affinity maturation can also be mimicked in vitro by constructing and reselecting from secondary libraries as described in the art. For example, mutations can be introduced at random in vitro by using error-prone polymerase. Additionally, affinity maturation can be performed by randomly mutating one or more CDRs, e.g., using PCR with primers carrying random sequence spanning the CDR of interest, in selected individual Fv clones and screening for higher affinity clones. Another approach is to recombine the $V_H$ or $V_L$ regions selected by phage display with repertoires of naturally occurring variable region variants obtained from unimmunized donors and screen for higher affinity in several rounds of chain reshuffling. This technique allows the production of antibodies and antibody fragments with a dissociation constant $K_d$ ($k_{off}/k_{on}$) of about $10^{-9}$ M or less.

Regardless of the type of antibody (e.g., chimeric, humanized, etc.), those skilled in the art will appreciate that immunoreactive or antigen-binding fragments of the same may also be used. In the broadest sense, an antibody fragment comprises at least a portion of an intact antibody (e.g., a naturally occurring immunoglobulin). More particularly the term "fragment" refers to a part or portion of an antibody or antibody chain comprising fewer amino acid residues than an intact or complete antibody or antibody chain. As used herein, the term "antigen-binding fragment" refers to a polypeptide fragment of an immunoglobulin or antibody that binds antigen or competes with intact antibody (i.e., with the intact antibody from which they were derived) for antigen binding (i.e., specific binding). As used herein, antigen-binding fragments included an antibody light chain ($V_L$), an antibody heavy chain ($V_H$), a single chain antibody (scFv), a F(ab')$_2$ fragment, a Fab fragment, an Fd fragment, an Fv fragment, single region antibody fragments, diabodies, linear antibodies, single-chain antibody molecules and multispecific antibodies formed from antibody fragments.

Those skilled in the art will also appreciate that antibody fragments can be obtained via chemical or enzymatic treatment of an intact or complete modulator (e.g., antibody or antibody chain) or by recombinant means. In this regard, while various antibody fragments are defined in terms of the digestion of an intact antibody, one of skill will appreciate that such fragments may be synthesized de novo either chemically or by using recombinant DNA methodology.

By way of example, papain digestion of antibodies produces two identical antigen-binding fragments, called Fab fragments, each with a single antigen-binding site, and a residual Fc fragment, whose name reflects its ability to crystallize readily. Pepsin treatment yields an F(ab')$_2$ fragment that has two antigen-binding sites and is still capable of cross-linking antigen. The Fab fragment also contains the constant region of the light chain and the first constant region ($C_H1$) of the heavy chain. Fab' fragments differ from Fab fragments by the addition of a few residues at the carboxy terminus of the heavy-chain $C_H1$ region including one or more cysteines from the antibody hinge region. Fab'-SH is the designation herein for Fab' in which the cysteine residue(s) of the constant regions bear at least one free thiol group. F(ab')$_2$ antibody fragments originally were produced as pairs of Fab' fragments that have hinge cysteines between them. Other chemical couplings of antibody fragments are also known.

By way of further example, an Fv fragment is an antibody fragment that contains a complete antigen recognition and binding site. This region is made up of a dimer of one heavy and one light chain variable region in tight association, which can be covalent in nature, for example in scFv. It is in this configuration that the three CDRs of each variable region interact to define an antigen binding site on the surface of the $V_H$-$V_L$ dimer. Collectively, the six CDRs or a subset thereof confer antigen binding specificity to the antibody. However, even a single variable region (or half of an Fv comprising only three CDRs specific for an antigen) has the ability to recognize and bind antigen, although usually at a lower affinity than the entire binding site.

In some embodiments an anti-coronavirus antibody fragment (e.g., anti-SARS-CoV-2 antibody fragment), for example, is one that comprises the Fc region, retains at least one of the biological functions normally associated with the Fc region when present in an intact antibody, such as FcRn binding, antibody half-life modulation, ADCC function and complement binding. In one embodiment, an antibody fragment is a monovalent antibody that has an in vivo half-life substantially similar to an intact antibody. For example, such an antibody fragment may comprise on antigen binding arm linked to an Fc sequence capable of conferring in vivo stability to the fragment.

Those skilled in the art will also appreciate that anti-coronavirus antibodies (e.g., anti-SARS-CoV-2 antibodies) disclosed herein may be monovalent or multivalent (e.g., bivalent, trivalent, etc.). As used herein, the term "valency" refers to the number of potential binding sites associated with an antibody. Each target binding site specifically binds one target molecule or specific position or locus on a target molecule. When an antibody of the instant invention comprises more than one target binding site (multivalent), each target binding site may specifically bind the same or different molecules (e.g., may bind to different ligands or different antigens, or different epitopes or positions on the same antigen). In some embodiment, anti-coronavirus antibodies (e.g., anti-SARS-CoV-2 antibodies) disclosed herein will be monovalent in that each binding site of the molecule will specifically bind to a single position or epitope. In other embodiments, the anti-coronavirus antibodies (e.g., anti-SARS-CoV-2 antibodies) disclosed herein will be multivalent in that they comprise more than one binding site and the different binding sites specifically associate with more than a single position or epitope. In such cases the multiple epitopes may be present on a virion or infected cell displaying viral antigen or a single epitope may be present on one molecule while a second, different epitope may be present on another molecule or surface.

As alluded to above, multivalent antibodies may immunospecifically bind to different epitopes of the desired target molecule or may immunospecifically bind to both the target molecule as well as a heterologous epitope, such as a heterologous polypeptide or solid support material. While some anti-coronavirus antibodies (e.g., anti-SARS-CoV-2 antibodies) disclosed herein only bind two antigens (i.e., are bispecific antibodies), antibodies with additional specificities such as tri-specific antibodies are also encompassed. Examples of bispecific antibodies include, without limitation, those with one arm directed against a SARS-CoV or SARS-CoV-2 Spike protein and the other arm directed against any other antigen. Methods for making bispecific antibodies are known in the art. Traditional production of full-length bispecific antibodies is based on the co-expression of two immunoglobulin heavy chain-light chain pairs, where the two chains have different specificities. Other more sophisticated compatible multispecific constructs and methods of their fabrication are also known.

In yet other embodiments, antibody variable regions with the desired binding specificities (antibody-antigen combining sites) are fused to immunoglobulin constant region sequences. The fusion preferably is with an immunoglobulin heavy chain constant region, comprising at least part of the hinge, $C_H2$, and/or $C_H3$ regions. In one example, the first heavy-chain constant region ($C_H1$) containing the site necessary for light chain binding is present in at least one of the fusions. DNAs encoding the immunoglobulin heavy chain fusions and, if desired, the immunoglobulin light chain, are inserted into separate expression vectors, and are co-transfected into a suitable host organism. This provides for great flexibility in adjusting the mutual proportions of the three polypeptide fragments in embodiments when unequal ratios of the three polypeptide chains used in the construction provide the optimum yields. It is, however, possible to insert the coding sequences for two or all three polypeptide chains in one expression vector when, the expression of at least two polypeptide chains in equal ratios results in high yields or when the ratios are of no particular significance.

In one embodiment of this approach, bispecific antibodies are composed of a hybrid immunoglobulin heavy chain with a first binding specificity in one arm and a hybrid immunoglobulin heavy chain-light chain pair (providing a second binding specificity) in the other arm. It was found that this asymmetric structure facilitates the separation of the desired bispecific compound from unwanted immunoglobulin chain combinations, as the presence of an immunoglobulin light chain in only one half of the bispecific molecule provides for a facile way of separation.

According to another approach known in the art, a pair of antibody molecules can be engineered to maximize the percentage of heterodimers that are recovered from recombinant cell culture. The preferred interface comprises at least a part of the $C_H3$ region of an antibody constant region. In this method, one or more small amino acid side chains from the interface of the first antibody molecule are replaced with larger side chains (e.g., tyrosine or tryptophan). Compensatory cavities of identical or similar size to the large side chain(s) are created on the interface of the second antibody molecule by replacing large amino acid side chains with smaller ones (e.g., alanine or threonine). This provides a mechanism for increasing the yield of the heterodimer over other unwanted end-products such as homodimers.

Bispecific antibodies also include cross-linked or heteroconjugate antibodies. Heteroconjugate antibodies may be made using any convenient cross-linking methods. Suitable cross-linking agents and techniques are well known in the art.

In addition to various modifications, substitutions, additions or deletions to the variable or binding regions of anti-coronavirus antibodies (e.g., anti-SARS-CoV-2 antibodies) disclosed herein, those skilled in the art will appreciate that selected embodiments may also comprise substitutions or modifications of the constant region (i.e., the Fc region). More particularly, it is contemplated that anti-coronavirus antibodies (e.g., anti-SARS-CoV-2 antibodies) disclosed herein may contain one or more additional amino acid residue substitutions, mutations and/or modifications, which result in a compound with preferred characteristics including, but not limited to: altered pharmacokinetics, increased serum half-life, increase binding affinity, reduced immunogenicity, increased production, altered Fc ligand binding, enhanced or reduced ADCC or CDC activity, altered glycosylation and/or disulfide bonds and modified binding specificity.

As used herein, the term "Fc region" defines a C-terminal region of an immunoglobulin heavy chain, including native sequence Fc regions and variant Fc regions. Although the boundaries of the Fc region of an immunoglobulin heavy chain might vary, the human IgG heavy chain Fc region is usually defined to stretch from an amino acid residue at position Cys226, or from Pro230, to the carboxyl-terminus thereof. The C-terminal lysine (residue 447 according to the EU numbering system) of the Fc region may be removed, for example, during production or purification of the antibody, or by recombinantly engineering the nucleic acid encoding a heavy chain of the antibody. Accordingly, a composition of intact antibodies may comprise antibody populations with all K447 residues removed, antibody populations with no K447 residues removed, and antibody populations having a mixture of antibodies with and without the K447 residue. A functional Fc region possesses an effector function of a native sequence Fc region. Exemplary effector functions include C1 q binding; CDC; Fc receptor binding; ADCC; phagocytosis; down regulation of cell surface receptors (e.g., B cell receptor; BCR), etc. Such effector functions generally require the Fc region to be combined with a binding region (e.g., an antibody variable region) and can be assessed using various assays as disclosed, for example, in definitions herein.

As used herein, the term "Fc receptor" or FcR describes a receptor that binds to the Fc region of an antibody. In some embodiments, an FcR is a native human FcR. In some embodiments, an FcR is one that binds an IgG antibody (a gamma receptor) and includes receptors of the FcγRI, Fc.RII, and FcγRIII subclasses, including allelic variants and alternatively spliced forms of those receptors. FcγII receptors include FcγRIIA (an activating receptor) and FcγRIIB (an inhibiting receptor), which have similar amino acid sequences that differ primarily in the cytoplasmic regions thereof.

Activating receptor Fcγ RIIA contains an immunoreceptor tyrosine-based activation motif (ITAM) in its cytoplasmic region. Inhibiting receptor FγRIIB contains an immunoreceptor tyrosine-based inhibition motif (ITIM) in its cytoplasmic region. Methods of measuring binding to FcRn are known in the art.

As used herein, "complement dependent cytotoxicity" or CDC refers to the lysing of a target cell in the presence of complement. The complement activation pathway is initiated by the binding of the first component of the complement system (C1 q) to a molecule, an antibody for example, complexed with a cognate antigen. To assess complement activation, a CDC assay may be performed. Further, antibody-dependent cell-mediated cytotoxicity or ADCC refers to a form of cytotoxicity in which secreted Ig bound onto Fc receptors (FcRs) present on certain cytotoxic cells (e.g., Natural Killer (NK) cells, neutrophils, and macrophages) enables these cytotoxic effector cells to bind specifically to an antigen-bearing target cell and subsequently kill the target cell with cytotoxins. Specific high-affinity IgG antibodies directed to the target arm cytotoxic cells and are absolutely required for such killing. Lysis of the target cell is extracellular, requires direct cell-to-cell contact, and does not involve complement.

Variant anti-coronavirus antibodies (e.g., anti-SARS-CoV-2 antibodies) disclosed herein that have altered FcR binding affinity or ADCC activity are those that have either enhanced or diminished FcR binding activity and/or ADCC activity compared to a parent or unmodified antibody or to a modulator comprising a native sequence Fc region. A variant antibody that displays increased binding to an FcR binds at least one FcR with better affinity than the parent or unmodified antibody or to a modulator comprising a native sequence Fc region. A variant antibody that displays decreased binding to an FcR, binds at least one FcR with worse affinity than the parent or unmodified antibody or to a modulator comprising a native sequence Fc region. Such variants which display decreased binding to an FcR may possess little or no appreciable binding to an FcR, e.g., 0-20% binding to the FcR compared to a native sequence IgG Fc region, e.g., as determined by techniques well known in the art. In some embodiments, the anti-coronavirus antibodies (e.g., anti-SARS-CoV-2 antibodies) disclosed herein have enhanced ADCC activities.

As to FcRn, anti-coronavirus antibodies (e.g., anti-SARS-CoV-2 antibodies) disclosed herein can also encompass Fc variants with modifications to the constant region that provide half-lives (e.g., serum half-lives) in a mammal, preferably a human, of greater than 5 days, greater than 10 days, greater than 15 days, preferably greater than 20 days, greater than 25 days, greater than 30 days, greater than 35 days, greater than 40 days, greater than 45 days, greater than 2 months, greater than 3 months, greater than 4 months, or greater than 5 months. The increased half-lives of the antibodies (or Fc containing molecules) of the present invention in a mammal, preferably a human, results in a higher serum titer of antibodies or antibody fragments in the mammal, and thus, reduces the frequency of the administration of antibodies or antibody fragments and/or reduces the concentration of antibodies or antibody fragments to be administered. Antibodies having increased in vivo half-lives can be generated by techniques known to those of skill in the art. For example, antibodies with increased in vivo half-lives can be generated by modifying (e.g., substituting, deleting, or adding) amino acid residues identified as involved in the interaction between the Fc region and the FcRn receptor. Binding to human FcRn in vivo and serum half-life of human FcRn high affinity binding polypeptides can be assayed, e.g., in transgenic mice or transfected human cell lines expressing human FcRn, or in primates to which the polypeptides with a variant Fc region are administered.

In some embodiments, the anti-SARS-CoV-2 antibodies disclosed herein can encompass an Fc region with modifications that improve their half-lives (e.g., serum half-lives) in a human. Studies have shown that some Fc mutation that enhances FcRn binding results in increased binding to rheumatoid factor (RF), whereas some Fc mutation combinations enhance FcRn binding and prolong antibody half-life without increased binding to RF, e.g., N434A/Y436T/Q438R/S440E (ACT1), N434A/Y436V/Q438R/S 440E (ACT2), M428L/N434A/Y436T/Q438R/S440E (ACT3), M428L/N434A/Y436V/Q438R/S440E (ACT4), M428L/N434A/Q438R/S440E (ACT5) (Maeda, et al., *MABS* 2017, 9(5): 844-853, positions numbered according to EU Index numbering). In some embodiments, the anti-SARS-CoV-2 antibodies disclosed herein comprise an Fc region comprising any set of mutations selected from ACT1, ACT2, ACT3, ACT4, or ACT5. In some embodiments, the anti-SARS-CoV-2 antibodies disclosed herein comprise an Fc region comprising the ACT5 mutations: M428L/N434A/Q438R/S440E (positions numbered according to EU Index numbering). For example, the anti-SARS-CoV-2 antibodies disclosed herein can comprise an Fc region comprising SEQ ID NO: 5367.

In still other embodiments, glycosylation patterns or compositions of the anti-coronavirus antibodies (e.g., anti-SARS-CoV-2 antibodies) disclosed herein are modified. More particularly, preferred embodiments may comprise one or more engineered glycoforms, i.e., an altered glycosylation pattern or altered carbohydrate composition that is covalently attached to a molecule comprising an Fc region. Engineered glycoforms may be useful for a variety of purposes, including but not limited to enhancing or reducing effector function, increasing the affinity of the antibody for a target antigen or facilitating production of the antibody. In cases where reduced effector function is desired, it will be appreciated that the antibody may be engineered to express in an aglycosylated form. Such carbohydrate modifications can be accomplished by, for example, altering one or more sites of glycosylation within the antibody sequence. That is, one or more amino acid substitutions can be made that result in elimination of one or more variable region framework glycosylation sites to thereby eliminate glycosylation at that site. Conversely, enhanced effector functions or improved binding may be imparted to the Fc containing molecule by engineering in one or more additional glycosylation sites.

Additionally, or alternatively, an Fc variant can be made that has an altered glycosylation composition, such as a hypofucosylated antibody having reduced amounts of fucosyl residues or an antibody having increased bisecting GlcNAc structures. These and similar altered glycosylation patterns have been demonstrated to increase the ADCC ability of antibodies. Engineered glycoforms may be generated by any method known to one skilled in the art, for example by using engineered or variant expression strains, by co-expression with one or more enzymes (for example N-acetylglucosaminyltransferase III (GnTI 1)), by expressing a molecule comprising an Fc region in various organisms or cell lines from various organisms or by modifying carbohydrate(s) after the molecule comprising Fc region has been expressed.

In some embodiments, the anti-coronavirus antibodies (e.g., anti-SARS-CoV-2 antibodies) described herein have reduced fucosylation. In some embodiments, the anti-coronavirus antibodies (e.g., anti-SARS-CoV-2 antibodies) described herein comprise an Fc region comprising N-glycoside-linked sugar chains bound to the Fc region, wherein the sugar chains do not contain fucose. In some embodiments, the anti-coronavirus antibodies (e.g., anti-SARS-CoV-2 antibodies) described herein have increased ADCC activities, compared to the same antibodies comprising N-glycoside-linked sugar chains that comprise fucose.

Characterization of Anti-Coronavirus Antibodies

No matter how obtained or which of the aforementioned forms the antibody modulator takes (e.g., humanized, human, etc.), anti-coronavirus antibodies (e.g., anti-SARS-CoV-2 antibodies) disclosed herein exhibit one or more desirable characteristics. Thus, anti-coronavirus antibody-producing cells (e.g., human B cells, hybridomas or yeast colonies) may be selected, cloned and further screened for these desirable characteristics including, for example, robust growth, high antibody production and, as discussed in more detail below, desirable antibody characteristics. Hybridomas can be expanded in vivo in syngeneic animals, in animals that lack an immune system, e.g., nude mice, or in cell culture in vitro. Methods of selecting, cloning and expanding hybridomas and/or colonies, each of which produces a discrete antibody species, are well known to those of ordinary skill in the art.

For example, anti-coronavirus antibodies (e.g., anti-SARS-CoV-2 antibodies) may be characterized by their ability to neutralize virions via the recognition of viral surface antigens essential for receptor binding and/or entry into host cells. Anti-coronavirus antibodies (e.g., anti-SARS-CoV-2 antibodies) may also be characterized by their ability to eliminate infected cells displaying viral antigens at their surface though complement-dependent cytotoxicity (CDC), antibody-dependent cellular phagocytosis (ADCP), or antibody-dependent cell-mediated cytotoxicity (ADCC). Anti-coronavirus antibodies (e.g., anti-SARS-CoV-2 antibodies) may also be characterized by their ability to directly impact viral propagation via antibody-dependent, cell-mediated virus inhibition (ADCVI). Anti-coronavirus antibodies (e.g., anti-SARS-CoV-2 antibodies) may also be characterized by their epitope specificity or a number of different physical characteristics including, e.g., binding affinities, melting temperature (Tm), and isoelectric points.

In some embodiments, anti-coronavirus antibodies (e.g., anti-SARS-CoV-2 antibodies) disclosed herein are neutralizing antibodies. As used herein, the term "neutralizing antibody" refers to an antibody that binds to or interacts with a virion and prevents binding or association of the virion with a host cell and/or entry into a host cell or acts as an egress inhibitor insofar as the antibody may not appear to be a neutralizing antibody in a conventional in vitro neutralization assay, but the antibody still inhibits propagation of the viral infection.

Examples of neutralization assays include conventional neutralization assays based on the inhibition of a virus cytopathic effect (CPE) on cells in culture. For example, neutralization may be tested by reducing or blocking formation of CPE in cells infected with SARS-CoV or SARS-CoV-2. Virus and antibody may be premixed before addition to cells, followed by measuring blocking of virus entry. Hemagglutinin inhibition (HI) may be tested in vitro and can detect the blocking of a virus' ability to bind to red blood cells. Antibodies that block the sialic acid receptor binding site will neutralize virus binding to cells, thereby blocking infection. Neutralization assays can also detect blocking of virus egress, as in the case of neuraminidase inhibitors like TAMIFLU®. In some embodiments, the neutralization assay can be a pseudoneutralization assay, for example, as described in the Examples below. In some embodiments, the neutralization assay can be a live virus neutralization assay, for example, as described in the Examples below.

In other embodiments, anti-coronavirus antibodies (e.g., anti-SARS-CoV-2 antibodies) disclosed herein are depleting antibodies. As used herein, the term "depleting antibody" refers to an antibody binds to or associates a SARS-CoV-2 antigen on or near the surface of an infected cell and induces, promotes, or causes the death, incapacitation, or elimination of the cell (e.g., by complement-dependent cytotoxicity (CDC), antibody-dependent cellular cytotoxicity (ADCC), or antibody-dependent cellular phagocytosis (ADCP)). Preferably a depleting antibody will be able to remove, incapacitate, eliminate, or kill at least 20%, 30%, 40%, 50%, 60%, 70%, 80%, 85%, 90%, 95%, 97%, or 99% of infected cells in a defined cell population.

Anti-coronavirus antibodies (e.g., anti-SARS-CoV-2 antibodies) disclosed herein may also be characterized by their epitope specificity. Anti-coronavirus antibodies (e.g., anti-SARS-CoV-2 antibodies) disclosed herein will associate with, or bind to, discrete epitopes or determinants presented by the selected target(s). As used herein, the term "epitope" refers to that portion of the target antigen capable of being recognized and specifically bound by a particular antibody. Epitopes can be formed both from contiguous amino acids and noncontiguous amino acids juxtaposed by tertiary folding of a protein. Epitopes formed from contiguous amino acids are typically retained upon protein denaturing, whereas epitopes formed by tertiary folding are typically lost upon protein denaturing. An epitope typically includes at least 3, and more usually, at least 5 to 10 amino acids in a unique spatial conformation. More specifically, the skilled artisan will appreciate the term epitope includes any protein determinant capable of specific binding to an immunoglobulin or T-cell receptor or otherwise interacting with a molecule. Epitopic determinants generally consist of chemically active surface groupings of molecules such as amino acids or carbohydrate or sugar side chains and generally have specific three-dimensional structural characteristics, as well as specific charge characteristics. Additionally, an epitope may be linear or conformational. In a linear epitope, all of the points of interaction between the protein and the interacting molecule (such as an antibody) occur linearly along the primary amino acid sequence of the protein. In a conformational epitope, the points of interaction occur across amino acid residues on the protein that are linearly separated from one another.

Once a desired epitope on an antigen is determined, it is possible to generate antibodies to that epitope, e.g., by immunizing with a peptide comprising the epitope using techniques known in the art. Alternatively, during the discovery process, the generation and characterization of antibodies may elucidate information about desirable epitopes. From this information, it is then possible to competitively screen antibodies for binding to the same epitope. An approach to achieve this is to conduct competition studies to find antibodies that competitively bind with one another, i.e., the antibodies compete for binding to the antigen. A high throughput process for binning antibodies based upon their cross-competition is known in the art.

As used herein, the term "binning" refers to a method to group antibodies based on their antigen binding characteristics. The grouping is somewhat arbitrary, depending on how different the observed binding patterns of the antibodies tested. Thus, while the technique is a useful tool for categorizing antibodies, the bins do not always directly correlate with epitopes and such initial determinations of epitope binding should be further confirmed by other art recognized methodology.

With this caveat one can determine whether a selected primary antibody (or fragment thereof) binds to the same epitope or cross competes for binding with a second antibody by using methods known in the art. In one embodiment, one exposes virions or one or more infected cell(s) to a first antibody under saturating conditions and then measures the ability of a second antibody to bind to the same population of virions or cell(s). If the second antibody is able to bind, then the second antibody binds to a different epitope than the first antibody. However, if the second antibody is not able to bind, then the second antibody binds to the same epitope, an overlapping epitope, or an epitope that is in close proximity to the epitope bound by the first antibody. As known in the art, the desired data can be obtained using solid phase direct or indirect radioimmunoassay (RIA), solid phase direct or indirect enzyme immunoassay (EIA), sandwich competition assay, surface plasmon resonance, biolayer interferometry, or flow cytometric methodology.

As used herein, the term "compete" means competition between antibodies as determined by an assay in which the antibody or immunologically-reactive fragment under test prevents or inhibits specific binding of a reference antibody to a common antigen. Typically, such an assay involves the use of purified antigen bound to a solid surface or cells bearing either of these, an unlabeled test immunoglobulin and a labeled reference immunoglobulin. Competitive inhibition is measured by determining the amount of label bound to the solid surface or cells in the presence of the test immunoglobulin. Usually, the test immunoglobulin is present in excess. Antibodies identified by competition assay (competing antibodies) include antibodies binding to the same epitope as the reference antibody and antibodies binding to an adjacent epitope sufficiently proximal to the epitope bound by the reference antibody for steric hindrance to occur. Additional details regarding methods for determining competitive binding are provided in the Examples herein. Usually, when a competing antibody is present in excess, it will inhibit specific binding of a reference antibody to a common antigen by at least 40%, 45%, 50%, 55%, 60%, 65%, 70% or 75%. In some instance, binding is inhibited by at least 80%, 85%, 90%, 95%, or 97% or more.

Anti-coronavirus antibodies (e.g., anti-SARS-CoV-2 antibodies) disclosed herein may also be characterized by their binding affinity. In some embodiments, anti-coronavirus antibodies (e.g., anti-SARS-CoV-2 antibodies) specifically bind to a target antigen expressed on a virion or infected cell, i.e., the dissociation constant $K_d$ ($k_{off}/k_{on}$) is $\leq 10^{-8}$M. The antibody specifically binds it antigen with high affinity when the $K_d$ is $\leq 5\times10^{-9}$M, and with very high affinity when the $K_d$ is $\leq 5\times10^{-10}$M. In particular embodiments, the antibody has a $K_d$ of $\leq 10^{-9}$M and an off-rate of about $1\times10^{-4}$/sec. In other embodiments, the off-rate is $\leq 1\times10^{-5}$/sec. In other embodiments, the antibodies will bind with a $K_d$ of between about $10^{-8}$M and $10^{-10}$M, and in yet other embodiments, antibodies bind with a $K_d \leq 2\times10^{-10}$M. Still other selected embodiments comprise antibodies that have a disassociation constant or $K_d$ ($k_{off}/k_{on}$) of less than $10^{-2}$M, less than $5\times10^{-2}$M, less than $10^{-3}$M, less than $5\times10^{-3}$M, less than $10^{-4}$M, less than $5\times10^{-4}$M, less than $10^{-5}$M, less than $5\times10^{-5}$M, less than $10^{-6}$M, less than $5\times10^{-6}$M, less than $10^{-7}$M, less than $5\times10^{-7}$M, less than $10^{-8}$M, less than $5\times10^{-8}$M, less than $10^{-9}$M, less than $5\times10^{-9}$M, less than $10^{-10}$M, less than $5\times10^{-10}$ M, less than $10^{-11}$M, less than $5\times10^{-11}$M, less than $10^{-12}$M, less than $5\times10^{-12}$M, less than $10^{-13}$M, less than $5\times10^{-13}$M, less than $10^{-14}$M, less than $5\times10^{-14}$M, less than $10^{-15}$M, or less than $5\times10^{-15}$M.

In another embodiment, an anti-coronavirus antibody (e.g., anti-SARS-CoV-2 antibody) that specifically binds to its antigen (e.g., on a virion or infected cell displaying a viral antigen) has an association rate constant or $k_{on}$ rate ((Ab)+ antigen $(Ag) \xrightarrow{k_{on}} Ab\text{-}Ag$) of at least $10^5 M^{-1} s^{-1}$, at least $2\times10^5 M^{-1} s^{-1}$, at least $5\times10^5 M^{-1} s^{-1}$, at least $10^6 M^{-1} s^{-1}$, at least $5\times10^6 M^{-1} s^{-1}$, at least $10^7 M^{-1} s^{-1}$, at least $5\times10^7 M^{-1} s^{-1}$, or at least $10^8 M^{-1} s^{-1}$.

In another embodiment, an anti-coronavirus antibody (e.g., anti-SARS-CoV-2 antibody) that specifically binds to its antigen (e.g., on a virion or infected cell displaying a viral antigen) has a disassociation rate constant or $k_{off}$ rate ((Ab)+ antigen $(Ag) \xrightarrow{k_{off}} Ab\text{-}Ag$) of less than $10^{-1} s^{-1}$, less than $5\times10^{-1} s^{-1}$, less than $10^{-2} s^{-1}$, less than $5\times10^{-2} s^{-1}$, less than $10^{-3} s^{-1}$, less than $5\times10^{-3} s^{-1}$, less than $10^{-4} s^{-1}$, less than $5\times10^{-4} s^{-1}$, less than $10^{-5} s^{-1}$, less than $5\times10^{-5} s^{-1}$, less than $10^{-6} s^{-1}$, less than $5\times10^{-6} s^{-1}$, less than $10^{-7} s^{-1}$, less than $5\times10^{-7} s^{-1}$, less than $10^{-8} s^{-1}$, less than $5\times10^{-8} s^{-1}$, less than $10^{-9} s^{-1}$, less than $5\times10^{-9} s^{-1}$ or less than $10^{-10} s^{-1}$.

In another embodiment, an anti-coronavirus antibody (e.g., anti-SARS-CoV-2 antibody) that specifically binds to its antigen (e.g., on a virion or infected cell displaying a viral antigen) will have an affinity constant or $K_a$ ($k_{on}/k_{off}$) of at least $10^2 M^{-1}$, at least $5\times10^2 M^{-1}$, at least $10^3 M^{-1}$, at least $5\times10^3 M^{-1}$, at least $10^4 M^{-1}$, at least $5\times10^4 M^{-1}$, at least $10^5 M^{-1}$, at least $5\times10^5 M^{-1}$, at least $10^6 M^{-1}$, at least $5\times10^6 M^{-1}$, at least $10^7 M^{-1}$, at least $5\times10^7 M^{-1}$, at least $10^8 M^{-1}$, at least $5\times10^8 M^{-1}$, at least $10^9 M^{-1}$, at least $5\times10^9 M^{-1}$, at least $10^{10} M^{-1}$, at least $5\times10^{10} M^{-1}$, at least 10 nM$^{-1}$, at least $5\times10$ nM$^{-1}$, at least $10^{12} M^{-1}$, at least $5\times10^{12} M^{-1}$, at least $10^{13} M^{-1}$, at least $5\times10^{13} M^{-1}$, at least $10^{14} M^{-1}$, at least $5\times10^{14} M^{-1}$, at least $10^{15} M^{-1}$ or at least $5\times10^{15} M^{-1}$.

Anti-coronavirus antibodies (e.g., anti-SARS-CoV-2 antibodies) disclosed herein may also be characterized by their thermal stability as reflected by their respective melting point (Tm). The Tm of the Fab region of an antibody can be a good indicator of the thermal stability of an antibody and may further provide an indication of the shelf life. Tm is merely the temperature of 50% unfolding for a given region or sequence. A lower Tm indicates more aggregation/less stability, whereas a higher Tm indicates less aggregation/more stability. Thus, antibodies or fragments or derivatives having higher Tm are preferable. Moreover, using art-recognized techniques it is possible to alter the composition of antibodies or regions thereof to increase or optimize molecular stability. Thermal melting temperatures (Tm) of a protein region (e.g., a Fab region) can be measured using any standard method known in the art, e.g., by differential scanning calorimetry.

In some embodiments, the Fab region of an anti-coronavirus antibody (e.g., anti-SARS-CoV-2 antibody) disclosed herein has a Tm value higher than at least 50° C., 55° C., 60° C., 65° C., 70° C., 75° C., 80° C., 85° C., 90° C., 95° C., 100° C., 105° C., 110° C., 115° C. or 120° C. In another embodiment, the Fab region of an anti-coronavirus antibody disclosed herein has a Tm value higher than at least about 50° C., about 55° C., about 60° C., about 65° C., about 70° C., about 75° C., about 80° C., about 85° C., about 90° C., about 95° C., about 100° C., about 105° C., about 110° C., about 115° C. or about 120° C.

Anti-coronavirus antibodies (e.g., anti-SARS-CoV-2 antibodies) disclosed herein may also be characterized by their isoelectric point (pI), which is generally defined as the pH at which a polypeptide carries no net charge. It is known in the art that protein solubility is typically lowest when the pH of the solution is equal to the isoelectric point (pi) of the protein. Therefore, it is possible to optimize solubility by altering the number and location of ionizable residues in the antibody to adjust the pI. For example, the pI of a polypeptide can be manipulated by making the appropriate amino acid substitutions (e.g., by substituting a charged amino acid such as a lysine, for an uncharged residue such as alanine). Without wishing to be bound by any particular theory, amino acid substitutions of an antibody that result in changes of the pI of said antibody may improve solubility and/or the stability of the antibody. One skilled in the art would understand which amino acid substitutions would be most appropriate for a particular antibody to achieve a desired pI. The pI of a protein may be determined by a variety of methods including but not limited to, isoelectric focusing and various computer algorithms.

In some embodiments, the pI of an anti-coronavirus antibody (e.g., anti-SARS-CoV-2 antibody) disclosed herein is higher than about 6.5, about 7.0, about 7.5, about 8.0, about 8.5, or about 9.0. In another embodiment, the pI of an anti-coronavirus antibody (e.g., anti-SARS-CoV-2 antibody) disclosed herein is higher than 6.5, 7.0, 7.5, 8.0, 8.5, or 9.0. In yet another embodiment, substitutions resulting in alterations in the pI of an anti-coronavirus antibody (e.g., anti-SARS-CoV-2 antibody) disclosed herein will not significantly diminish its binding affinity. As discussed in more detail below, it is specifically contemplated that the substitution(s) of the Fc region that result in altered binding to FcγR may also result in a change in the pI. In a preferred embodiment, substitution(s) of the Fc region are specifically chosen to effect both the desired alteration in FcγR binding and any desired change in pI. As used herein, the pI value is defined as the pI of the predominant charge form.

Nucleic Acids and Anti-Coronavirus Antibody Expression

Provided herein are also nucleic acids encoding a heavy chain or light chain, or a VH or VL, of the novel anti-coronavirus antibodies (e.g., anti-SARS-CoV-2 antibodies) disclosed herein, and vectors comprising one or more such nucleic acids. The terms "nucleic acid" or "polynucleotide", as used interchangeably herein, refer to polymers of nucleotides, including single-stranded and/or double-stranded nucleotide-containing molecules, such as DNA, cDNA and RNA molecules, incorporating native, modified, and/or analogs of, nucleotides. Polynucleotides of the present disclosure may also include substrates incorporated therein, for example, by DNA or RNA polymerase or a synthetic reaction. In some embodiments, provided herein are nucleic acids encoding a heavy chain or light chain of the anti-SARS-CoV-2 antibodies described herein, e.g., any one of Abs 258 to 577 and 589 to 1587. In some embodiments, provided herein are nucleic acids encoding a VH or VL of the anti-SARS-CoV-2 antibodies described herein, e.g., any one of Abs 258 to 577 and 589 to 1587. In some embodiments, provided herein are nucleic acids encoding a VH or VL comprising any one of SEQ ID NOs: 661-1320, 2751-4180, and 4749-5316. In some embodiments, provided herein are nucleic acids comprising a sequence from any one of SEQ ID NOs: 1-660, 1321-2750, and 4181-4748.

In some embodiments, provided herein are nucleic acids encoding a heavy chain or light chain of the anti-SARS- CoV-2 antibodies described herein. For example, amino acid sequences of the heavy chains of such antibodies are set forth in odd numbered SEQ ID NOs: 5319-5366, 5575-5592, and 5707-5744 and amino acid sequences of the light chains of these antibodies are set forth in odd numbered SEQ ID NOs: 5319-5366, 5575-5592, and 5707-5744. In some embodiments, provided herein are nucleic acids encoding a heavy chain comprising SEQ ID NO: 5363, a light chain comprising SEQ ID NO: 5364, or both a heavy chain comprising SEQ ID NO: 5363 and a light chain comprising SEQ ID NO: 5364. In some embodiments, provided herein are nucleic acids encoding a heavy chain comprising SEQ ID NO: 5335, a light chain comprising SEQ ID NO: 5336, or both a heavy chain comprising SEQ ID NO: 5335 and a light chain comprising SEQ ID NO: 5336. In some embodiments, provided herein are nucleic acids encoding a heavy chain comprising SEQ ID NO: 5347, a light chain comprising SEQ ID NO: 5348, or both a heavy chain comprising SEQ ID NO: 5347 and a light chain comprising SEQ ID NO: 5348. In some embodiments, provided herein are nucleic acids encoding a heavy chain comprising SEQ ID NO: 5351, a light chain comprising SEQ ID NO: 5352, or both a heavy chain comprising SEQ ID NO: 5351 and a light chain comprising SEQ ID NO: 5352. In some embodiments, provided herein are nucleic acids encoding a heavy chain comprising SEQ ID NO: 5325, a light chain comprising SEQ ID NO: 5326, or both a heavy chain comprising SEQ ID NO: 5325 and a light chain comprising SEQ ID NO: 5326. In some embodiments, provided herein are nucleic acids encoding a heavy chain comprising SEQ ID NO: 5735, a light chain comprising SEQ ID NO: 5736, or both a heavy chain comprising SEQ ID NO: 5735 and a light chain comprising SEQ ID NO: 5736.

Exemplary nucleic acids encoding heavy and light chains of the anti-SARS-CoV-2 antibodies described in the preceding paragraph, as well as exemplary nucleic acids encoding other exemplary anti-SARS-CoV-2 antibodies disclosed herein are provided below:

```
851 Heavy chain nt sequence
                                                           (SEQ ID NO: 5745)
CAGATCACCTTGAAGGAGTCTGGTCCTACGCTGGTGAAACCCACACAGACCCTCACGCTGACCTGCAC

CTTCTCTGGGTTCTCACTCAGCACTAATGGAGTGGGTATGGGCTGGATCCGTCAGCCCCCAGGAAAGG

CCCTGGAGTGGCTTGCACTCATTTATTGGGATGATGATCAGTTCTACAGCCCATCTCTGAAGAGCAGGC

TCACCATCACCAGGGACACCTCCAAAAACCAGGTGGTCCTTACAATGACCAACATGGACCCTGTGGAC

ACAGCCACATATTACTGTGCACAAGCCTTCTATGAGAGTTTCGGTTTTTACTCCTGGGGCCAGGGAACC

CTGGTCACCGTCTCCTCAGCCTCCACCAAGGGCCCATCGGTCTTCCCCCTGGCACCCTCCTCCAAGAGC

ACCTCTGGGGGCACAGCGGCCCTGGGCTGCCTGGTCAAGGACTACTTCCCCGAACCGGTGACGGTGTC

GTGGAACTCAGGCGCACTGACCAGCGGCGTGCACACCTTCCCGGCTGTCCTACAGTCCTCAGGACTCT

ACTCCCTCAGCAGCGTGGTGACCGTGCCCTCCAGCAGCTTGGGCACCCAGACCTACATCTGCAACGTG

AATCACAAGCCCAGCAACACCAAGGTGGACAAGAGAGTTGAGCCCAAATCTTGTGACAAAACTCACA

CATGCCCACCGTGCCCAGCACCTGAACTCCTGGGGGGACCGTCAGTCTTCCTCTTCCCCCCAAAACCCA

AGGACACCCTCATGATCTCCCGGACCCCTGAGGTCACATGCGTGGTGGTGGACGTGAGCCACGAAGAC

CCTGAGGTCAAGTTCAACTGGTATGTGGACGGCGTGGAGGTGCATAATGCCAAGACAAAGCCGCGGG

AGGAGCAGTACAACAGCACGTACCGTGTGGTCAGCGTCCTCACCGTCCTGCACCAAGACTGGCTGAAT

GGCAAGGAGTACAAGTGCAAGGTCTCCAACAAAGCCCTCCCAGCCCCCATCGAGAAAACCATCTCCA

AAGCCAAAGGGCAGCCCCGAGAACCACAGGTGTACACCCTGCCCCCATCCCGGGAGGAGATGACCAA

GAACCAAGTCAGCCTGACCTGCCTGGTCAAAGGCTTCTATCCCAGCGACATCGCCGTGGAGTGGGAGA

GCAATGGGCAGCCGGAGAACAACTACAAGACCACGCCTCCCGTGCTGGACTCCGACGGCTCCTTCTTC

CTCTATTCCAAGCTCACCGTGGACAAGAGCAGGTGGCAGCAGGGGAACGTCTTCTCATGCTCCGTGAT

GCATGAGGCTCTGCACAACCACTACACGCAGAAGAGCCTCTCCCTGTCTCCGGGCAAA

851 Light chain nt sequence
                                                           (SEQ ID NO: 5746)
AATTTTATGCTGACTCAGCCGCACTCTGTGTCGGAGTCTCCGGGGAAGACGGTAATCATCTCCTGCACC

CGCAGCATTGGCAGCATTGCCAGCAACTATGTGCAGTGGTACCAGCAGCGCCCGGGCAGTGCCCCCAC

CATTGTGGTCTTTGAGGATAACGAGAGACCCTCTGGGGTCCCTGATCGGTTCTCTGGCTCCATCGACCG

CTCCTCCAACTCTGCCTCCCTCACCATCTCTGGACTGAAGACTGAGGACGAGGCTGACTACTACTGTCA

GTCTTATGATGGCTCCAGTGAATTGGTATTCGGCGGAGGGACCAAGCTGACCGTCCTAGGCCAGCCCA

AGGCTGCCCCCTCGGTCACTCTGTTCCCGCCCTCCTCTGAGGAGCTTCAAGCCAACAAGGCCACACTG
```

-continued

GTGTGTCTCATAAGTGACTTCTACCCGGGAGCCGTGACAGTGGCCTGGAAGGCAGATAGCAGCCCCGT

CAAGGCGGGAGTGGAGACAACCACACCCTCCAAACAAAGCAACAACAAGTACGCGGCCAGCAGCTAT

CTGAGCCTGACGCCTGAGCAGTGGAAGTCCCACAGAAGCTACAGCTGCCAGGTCACGCATGAAGGGA

GCACCGTGGAGAAGACAGTGGCCCCTACAGAATGTTCA

894 Heavy chain nt sequence
(SEQ ID NO: 5747)
CAGGTCCAGCTGGTACAGTCTGGGGCTGAGGTGAAGAAGCCTGGGGCCTCAGTGAAGGTCTCCTGCAA

GGTTTCCGGATACACCCTCCCTGAATTATCCATACACTGGGTGCGACAGGCTCCTGGAAAAGGGCTTG

AGTGGATGGGAGGTTTTGATCCTGAAAATGCTGAAACAATCTACACACAGAAGTTCCAGGGCAGACTC

ACCATGACCGAGGACACATCTACAGACACAGCCTACATGGAGCTGAGCAGCCTGAGATCTGAGGACA

CGGCCATGTATTACTGTGCAACAAGTTTTGTACTAATGCCGGCTGCTCTGGGGGATTACTCCTACTACT

ACGGTATGGACGTCTGGGGCCAAGGGACCACGGTCACCGTCTCCTCAGCCTCCACCAAGGGCCCATCG

GTCTTCCCCCTGGCACCCTCCTCCAAGAGCACCTCTGGGGGCACAGCGGCCCTGGGCTGCCTGGTCAA

GGACTACTTCCCCGAACCGGTGACGGTGTCGTGGAACTCAGGCGCACTGACCAGCGGCGTGCACACCT

TCCCGGCTGTCCTACAGTCCTCAGGACTCTACTCCCTCAGCAGCGTGGTGACCGTGCCCTCCAGCAGCT

TGGGCACCCAGACCTACATCTGCAACGTGAATCACAAGCCCAGCAACACCAAGGTGGACAAGAGAGT

TGAGCCCAAATCTTGTGACAAAACTCACACATGCCCACCGTGCCCAGCACCTGAACTCCTGGGGGGAC

CGTCAGTCTTCCTCTTCCCCCCAAAACCCAAGGACACCCTCATGATCTCCCGGACCCCTGAGGTCACAT

GCGTGGTGGTGGACGTGAGCCACGAAGACCCTGAGGTCAAGTTCAACTGGTATGTGGACGGCGTGGA

GGTGCATAATGCCAAGACAAAGCCGCGGGAGGAGCAGTACAACAGCACGTACCGTGTGGTCAGCGTC

CTCACCGTCCTGCACCAAGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACC

CTGCCCCCATCCCGGGAGGAGATGACCAAGAACCAAGTCAGCCTGACCTGCCTGGTCAAAGGCTTCTA

TCCCAGCGACATCGCCGTGGAGTGGGAGAGCAATGGGCAGCCGGAGAACAACTACAAGACCACGCCT

CCCGTGCTGGACTCCGACGGCTCCTTCTTCCTCTATTCCAAGCTCACCGTGGACAAGAGCAGGTGGCA

GCAGGGGAACGTCTTCTCATGCTCCGTGATGCATGAGGCTCTGCACAACCACTACACGCAGAAGAGCC

TCTCCCTGTCTCCGGGCAAA

894 Light chain nt sequence
(SEQ ID NO: 5748)
GATATTGTGATGACCCAGACTCCACTCTCCTCACCTGTCACCCTTGGACAGCCGGCCTCCATCTCCTGC

AGGTCTAGTCAAAGCCTCGTACACAGTGATGGAAACACCTACTTGAGTTGGCTTCAGCAGAGGCCAGG

CCAGCCTCCAAGACTCCTAATTTATAAGATTTCTAACCGGTTCTCTGGGGTCCCAGACAGATTCAGTGG

CAGTGGGGCAGGGACAGATTTCACACTGAAAATCAGCAGGGTGGAAGCTGAGGATGTCGGGGTTTAT

TACTGCATGCAAGCTACACAATTTCCTCTCACTTTCGGCGGAGGGACCAAGGTGGAGATCAAAGAAC

TGTGGCGGCGCCATCTGTCTTCATCTTCCCGCCATCTGATGAGCAGTTGAAATCCGGAACTGCCTCTGT

TGTGTGCCTGCTGAATAACTTCTATCCCAGAGAGGCCAAAGTACAGTGGAAGGTGGATAACGCCCTCC

AATCGGGTAACTCCCAGGAGAGTGTCACAGAGCAGGACAGCAAGGACAGCACCTACAGCCTCAGCAG

CACCCTGACGCTGAGCAAAGCAGACTACGAGAAACACAAAGTCTACGCCTGCGAAGTCACCCATCAG

GGCCTGAGCTCGCCCGTCACAAAGAGCTTCAACAGGGGAGAGTGC

896 Heavy chain nt sequence
(SEQ ID NO: 5749)
GAAGTGCAGCTGGTGGAGTCTGGGGGAGGCGTGGTACAGCCTGGGGGGTCCCTGAGACTCTCCTGTGC

AGCCTCTGGATTCACCTTTGATGATTATGCCATGCACTGGGTCCGTCAAGTTCCAGGGAAGGGTCTGG

AGTGGGTCTCTCTTATTAGTGGGGATGGTGGTAGCACATACTATGCAGACTCTGTGAAGGGCCGATTC

```
ACCATCTCCAGAGACAACAGCAAAAACTCCCTGTATGTGCAAATGAACAGTCTGAGAACTGAGGACA

CCGCCTTGTATTACTGTGTAAAAGATAGAGGGGGCAGTGGCTGGGACCTCAACCACTACTACTACGGT

ATGGACGTCTGGGGCCAAGGGACCACGGTCACCGTCTCCTCAGCCTCCACCAAGGGCCCATCGGTCTT

CCCCCTGGCACCCTCCTCCAAGAGCACCTCTGGGGGCACAGCGGCCCTGGGCTGCCTGGTCAAGGACT

ACTTCCCCGAACCGGTGACGGTGTCGTGGAACTCAGGCGCACTGACCAGCGGCGTGCACACCTTCCCG

GCTGTCCTACAGTCCTCAGGACTCTACTCCCTCAGCAGCGTGGTGACCGTGCCCTCCAGCAGCTTGGGC

ACCCAGACCTACATCTGCAACGTGAATCACAAGCCCAGCAACACCAAGGTGGACAAGAGAGTTGAGC

CCAAATCTTGTGACAAAACTCACACATGCCCACCGTGCCCAGCACCTGAACTCCTGGGGGGACCGTCA

GTCTTCCTCTTCCCCCCAAAACCCAAGGACACCCTCATGATCTCCCGGACCCCTGAGGTCACATGCGTG

GTGGTGGACGTGAGCCACGAAGACCCTGAGGTCAAGTTCAACTGGTATGTGGACGGCGTGGAGGTGC

ATAATGCCAAGACAAAGCCGCGGGAGGAGCAGTACAACAGCACGTACCGTGTGGTCAGCGTCCTCAC

CGTCCTGCACCAAGACTGGCTGAATGGCAAGGAGTACAAGTGCAAGGTCTCCAACAAAGCCCTCCCA

GCCCCCATCGAGAAAACCATCTCCAAAGCCAAAGGGCAGCCCCGAGAACCACAGGTGTACACCCTGC

CCCCATCCCGGGAGGAGATGACCAAGAACCAAGTCAGCCTGACCTGCCTGGTCAAAGGCTTCTATCCC

AGCGACATCGCCGTGGAGTGGGAGAGCAATGGGCAGCCGGAGAACAACTACAAGACCACGCCTCCCG

TGCTGGACTCCGACGGCTCCTTCTTCCTCTATTCCAAGCTCACCGTGGACAAGAGCAGGTGGCAGCAG

GGGAACGTCTTCTCATGCTCCGTGATGCATGAGGCTCTGCACAACCACTACACGCAGAAGAGCCTCTC

CCTGTCTCCGGGCAAA

896 Light chain nt sequence
                                                                (SEQ ID NO: 5750)
GACATCCAGTTGACCCAGTCTCCATCCTTCCTGTCTGCATCTGTAGGAGACAGAGTCACCGTCACTTGC

CGGGCCAGTCAGGGCATTAGCAGTTATTTAGCCTGGTATCAGCAAAAACCAGGGAAAGCCCCTAAGCT

CCTCATCTATGCTGCATACACTTTGCAAAGTGGGGTCCCATCAAGGTTCAGCGGCAGTGGATCTGAGA

CAGAATTCACTCTCACAATCAGCAGCCTGCAGCCTGAAGATTTTGCAACTTATTACTGTCAACAGGTTA

AGAGTTACCCTCTCACTTTCGGCGGAGGGACCAAGGTGGAGATCAAAAGAACTGTGGCGGCGCCATCT

GTCTTCATCTTCCCGCCATCTGATGAGCAGTTGAAATCCGGAACTGCCTCTGTTGTGTGCCTGCTGAAT

AACTTCTATCCCAGAGAGGCCAAAGTACAGTGGAAGGTGGATAACGCCCTCCAATCGGGTAACTCCCA

GGAGAGTGTCACAGAGCAGGACAGCAAGGACAGCACCTACAGCCTCAGCAGCACCCTGACGCTGAGC

AAAGCAGACTACGAGAAACACAAAGTCTACGCCTGCGAAGTCACCCATCAGGGCCTGAGCTCGCCCG

TCACAAAGAGCTTCAACAGGGGAGAGTGC

923 Heavy chain nt sequence
                                                                (SEQ ID NO: 5751)
GAGGTGCAGCTGGTGGAGTCTGGGGGAGGTGTGGTACGGCCTGGGGGGTCCCTGAGACTCTCCTGTGC

AGCCTCTGGATTCATCTTTGATGATTATGACATGACCTGGGTCCGCCAAGCTCCAGGGAAGGGGCTGG

AGTGGGTCTCTGGTATTAGTTGGAATGGTGGTAACACAGGTTATGCAGACTCTGTGAAGGGCCGATTC

ACCATCTCCAGAGACAACGCCAAGAACTCCCTGTATCTGCAAATGAACAGTCTGAGAGCCGAGGACA

CGGCCTTGTATCACTGTGCAGTGATTATGTCTCCAATCCCCCGTTATAGTGGCTACGATTGGGCGGGTG

GTGCTTTTGATATCTGGGGCCAAGGGACAATGGTCACCGTCTCTTCAGCCTCCACCAAGGGCCCATCG

GTCTTCCCCCTGGCACCCTCCTCCAAGAGCACCTCTGGGGGCACAGCGGCCCTGGGCTGCCTGGTCAA

GGACTACTTCCCCGAACCGGTGACGGTGTCGTGGAACTCAGGCGCACTGACCAGCGGCGTGCACACCT

TCCCGGCTGTCCTACAGTCCTCAGGACTCTACTCCCTCAGCAGCGTGGTGACCGTGCCCTCCAGCAGCT

TGGGCACCCAGACCTACATCTGCAACGTGAATCACAAGCCCAGCAACACCAAGGTGGACAAGAGAGT
```

-continued

TGAGCCCAAATCTTGTGACAAAACTCACACATGCCCACCGTGCCCAGCACCTGAACTCCTGGGGGAC

CGTCAGTCTTCCTCTTCCCCCCAAAACCCAAGGACACCCTCATGATCTCCCGGACCCCTGAGGTCACAT

GCGTGGTGGTGGACGTGAGCCACGAAGACCCTGAGGTCAAGTTCAACTGGTATGTGGACGGCGTGGA

GGTGCATAATGCCAAGACAAAGCCGCGGGAGGAGCAGTACAACAGCACGTACCGTGTGGTCAGCGTC

CTCACCGTCCTGCACCAAGACTGGCTGAATGGCAAGGAGTACAAGTGCAAGGTCTCCAACAAAGCCCT

CCCAGCCCCCATCGAGAAAACCATCTCCAAAGCCAAAGGGCAGCCCCGAGAACCACAGGTGTACACC

CTGCCCCCATCCCGGGAGGAGATGACCAAGAACCAAGTCAGCCTGACCTGCCTGGTCAAAGGCTTCTA

TCCCAGCGACATCGCCGTGGAGTGGGAGAGCAATGGGCAGCCGGAGAACAACTACAAGACCACGCCT

CCCGTGCTGGACTCCGACGGCTCCTTCTTCCTCTATTCCAAGCTCACCGTGGACAAGAGCAGGTGGCA

GCAGGGGAACGTCTTCTCATGCTCCGTGATGCATGAGGCTCTGCACAACCACTACACGCAGAAGAGCC

TCTCCCTGTCTCCGGGCAAA

923 Light chain nt sequence (SEQ ID NO: 5752)

TCTTCTGAGCTGACTCAGGACCCTGCTGTGTCTGTGGCCTTGGGACAGACAGTCAGGATCACATGCCA

AGGAGACAGCCTCAGAAGCTATTATGCAAGCTGGTACCAGCAGAAGCCAGGACAGGTCCCTATACTT

GTCATCTATGATAAAAACAACCGGCCCTCAGGGATCCCAGACCGATTCTCTGGCTCCAGCTCAGGAAA

CACAGCTTCCTTGACCATCACTGGGGCTCAGGCGGAAGATGAGGCTGACTATTACTGTAACTCCCGGG

ACAGCAGTGGTAACGCCGTGGTGTTCGGCGGAGGGACCAAGCTGACCGTCCTAGGCCAGCCCAAGGC

TGCCCCCTCGGTCACTCTGTTCCCGCCCTCCTCTGAGGAGCTTCAAGCCAACAAGGCCACACTGGTGTG

TCTCATAAGTGACTTCTACCCGGGAGCCGTGACAGTGGCCTGGAAGGCAGATAGCAGCCCCGTCAAGG

CGGGAGTGGAGACAACCACACCCTCCAAACAAAGCAACAACAAGTACGCGGCCAGCAGCTATCTGAG

CCTGACGCCTGAGCAGTGGAAGTCCCACAGAAGCTACAGCTGCCAGGTCACGCATGAAGGGAGCACC

GTGGAGAAGACAGTGGCCCCTACAGAATGTTCA

936 Heavy chain nt sequence (SEQ ID NO: 5753)

GAAGTGCAGCTGGTGGAGTCTGGGGGAGGCTTGGTACAGCCTGGCAGGTCCCTGACACTCTCCTGTGC

AGGCTCTGGATTCACCTTTGATGATTATGCCATGCACTGGGTCCGGCAAGCTCCAGGGAAGGGCCTGG

AGTGGGTCTCAGGTATTAGTTGGAATAGTGGTAGCATAGGCTATGCGGACTCTGTGAAGGGCCGATTC

ACCATCTCCAGAGACAACGCCAAGAACTCCCTATATCTGCAAATGAACAGTCTGAGAGCTGAGGACAC

GGCCTTGTATTACTGTGCAAAAGATGTCTCCTATGATAGTAGTGGTTATTACAACAATGCTTTTGATAT

CTGGGGCCAAGGGACAATGGTCACCGTCTCTTCAGCCTCCACCAAGGGCCCATCGGTCTTCCCCCTGG

CACCCTCCTCCAAGAGCACCTCTGGGGGCACAGCGGCCCTGGGCTGCCTGGTCAAGGACTACTTCCCC

GAACCGGTGACGGTGTCGTGGAACTCAGGCGCACTGACCAGCGGCGTGCACACCTTCCCGGCTGTCCT

ACAGTCCTCAGGACTCTACTCCCTCAGCAGCGTGGTGACCGTGCCCTCCAGCAGCTTGGGCACCCAGA

CCTACATCTGCAACGTGAATCACAAGCCCAGCAACACCAAGGTGGACAAGAGAGTTGAGCCCAAATC

TTGTGACAAAACTCACACATGCCCACCGTGCCCAGCACCTGAACTCCTGGGGGGACCGTCAGTCTTCC

TCTTCCCCCCAAAACCCAAGGACACCCTCATGATCTCCCGGACCCCTGAGGTCACATGCGTGGTGGTG

GACGTGAGCCACGAAGACCCTGAGGTCAAGTTCAACTGGTATGTGGACGGCGTGGAGGTGCATAATG

CCAAGACAAAGCCGCGGGAGGAGCAGTACAACAGCACGTACCGTGTGGTCAGCGTCCTCACCGTCCT

GCACCAAGACTGGCTGAATGGCAAGGAGTACAAGTGCAAGGTCTCCAACAAAGCCCTCCCAGCCCCC

ATCGAGAAAACCATCTCCAAAGCCAAAGGGCAGCCCCGAGAACCACAGGTGTACACCCTGCCCCCAT

CCCGGGAGGAGATGACCAAGAACCAAGTCAGCCTGACCTGCCTGGTCAAAGGCTTCTATCCCAGCGAC

ATCGCCGTGGAGTGGGAGAGCAATGGGCAGCCGGAGAACAACTACAAGACCACGCCTCCCGTGCTGG

-continued

ACTCCGACGGCTCCTTCTTCCTCTATTCCAAGCTCACCGTGGACAAGAGCAGGTGGCAGCAGGGGAAC
GTCTTCTCATGCTCCGTGATGCATGAGGCTCTGCACAACCACTACACGCAGAAGAGCCTCTCCCTGTCT
CCGGGCAAA

936 Light chain nt sequence
(SEQ ID NO: 5754)
GACATCCAGTTGACCCAGTCTCCATCCTTCCTGTCTGCATCTGTAGGAGACAGAGTCACCATCACTTGC
CGGGCCAGTCAGGGCATTAGCAGTTATTTAGCCTGGTATCAGCAAAAACCAGGGAAAGCCCCTAAGCT
CCTGATCTATGCTGCATCCACTTTGCAAAGTGGGGTCCCATCAAGGTTCAGCGGCAGTGGATCTGGGA
CAGAATTCACTCTCACAATAAGCAGCCTGCAGCCTGAAGATTTTGCAACTTATTACTGTCAACAACTTT
ATAGTTACCCGGTCACCTTCGGCCAAGGGACACGACTGGAGATTAAAAGAACTGTGGCGGCGCCATCT
GTCTTCATCTTCCCGCCATCTGATGAGCAGTTGAAATCCGGAACTGCCTCTGTTGTGTGCCTGCTGAAT
AACTTCTATCCCAGAGAGGCCAAAGTACAGTGGAAGGTGGATAACGCCCTCCAATCGGGTAACTCCCA
GGAGAGTGTCACAGAGCAGGACAGCAAGGACAGCACCTACACGCCTCAGCAGCACCCTGACGCTGAGC
AAAGCAGACTACGAGAAACACAAAGTCTACGCCTGCGAAGTCACCCATCAGGGCCTGAGCTCGCCCG
TCACAAAGAGCTTCAACAGGGGAGAGTGC 970 Heavy chain nt sequence
(SEQ ID NO: 5755)
GAGGTGCAGCTGGTGGAGTCTGGGGGAGGCTTGGTCCAGCCTGGGGGGTCCCTGAGACTCTCCTGTGC
AGCCTCTGGATTCACCTTTAGTAGTTATTGGATGAGCTGGGTCCGCCAGGCTCCAGGGAAGGGGCTGG
AGTGGGTGGCCAACATAAACAAAGATGGAAGTGAGAAATACTATGTGGACTCTGTGAAGGGCCGATT
CACCATCTCCAGAGACAACGCCAAGAACTCACTGTATCTGCAAATGAACAGCCTGCGAGCCGAGGAC
ACGGCTGTGTATTTCTGTGCGAGAGATTATCGATATTTTGACTGGTTATTATCGCAAATAGACTTGGAG
ATTGACTACTTTGACTACTGGGGCCAGGGAACCCTGGTCACCGTCTCCTCAGCCTCCACCAAGGGCCC
ATCGGTCTTCCCCCTGGCACCCTCCTCCAAGAGCACCTCTGGGGGCACAGCGGCCCTGGGCTGCCTGG
TCAAGGACTACTTCCCCGAACCGGTGACGGTGTCGTGGAACTCAGGCGCACTGACCAGCGGCGTGCAC
ACCTTCCCGGCTGTCCTACAGTCCTCAGGACTCTACTCCCTCAGCAGCGTGGTGACCGTGCCCTCCAGC
AGCTTGGGCACCCAGACCTACATCTGCAACGTGAATCACAAGCCCAGCAACACCAAGGTGGACAAGA
GAGTTGAGCCCAAATCTTGTGACAAAACTCACACATGCCCACCGTGCCCAGCACCTGAACTCCTGGGG
GGACCGTCAGTCTTCCTCTTCCCCCCAAAACCCAAGGACACCCTCATGATCTCCCGGACCCCTGAGGTC
ACATGCGTGGTGGTGGACGTGAGCCACGAAGACCCTGAGGTCAAGTTCAACTGGTATGTGGACGGCGT
GGAGGTGCATAATGCCAAGACAAAGCCGCGGGAGGAGCAGTACAACAGCACGTACCGTGTGGTCAGC
GTCCTCACCGTCCTGCACCAAGACTGGCTGAATGGCAAGGAGTACAAGTGCAAGGTCTCCAACAAAGC
CCTCCCAGCCCCCATCGAGAAAACCATCTCCAAAGCCAAAGGGCAGCCCCGAGAACCACAGGTGTAC
ACCCTGCCCCCATCCCGGGAGGAGATGACCAAGAACCAAGTCAGCCTGACCTGCCTGGTCAAAGGCTT
CTATCCCAGCGACATCGCCGTGGAGTGGGAGAGCAATGGGCAGCCGGAGAACAACTACAAGACCACG
CCTCCCGTGCTGGACTCCGACGGCTCCTTCTTCCTCTATTCCAAGCTCACCGTGGACAAGAGCAGGTGG
CAGCAGGGGAACGTCTTCTCATGCTCCGTGATGCATGAGGCTCTGCACAACCACTACACGCAGAAGAG
CCTCTCCCTGTCTCCGGGCAAA 970 Light chain nt sequence
(SEQ ID NO: 5756)
GACATCCAGATGACCCAGTCTCCATCCTCCCTGTCTGCATCTGTAGGAGACAGAGTCACCATCACTTGC
CGGGCAAGTCAGAGCATTAGCAGTTATTTAAATTGGTATCAGCAGAAACCAGGGAAAGCCCCTAAGG
TCCTGATCTATGCTGCATCCAGTTTGCAAAGTGGGGTCCCATCAAGGTTCAGTGGCAGTGGATCTGGG -continued

ACAGATTTCACTCTCACCATCAGCAGTCTGCAACCTGAAGATTTTGCAACTTACTACTGTCAACAGAGT

TACAGTACCCCTCTCACTTTCGGCGGAGGGACCAAGGTGGAGATCAAAAGAACTGTGGCGGCGCCATC

TGTCTTCATCTTCCCGCCATCTGATGAGCAGTTGAAATCCGGAACTGCCTCTGTTGTGCCTGCTGAA

TAACTTCTATCCCAGAGAGGCCAAAGTACAGTGGAAGGTGGATAACGCCCTCCAATCGGGTAACTCCC

AGGAGAGTGTCACAGAGCAGGACAGCAAGGACAGCACCTACAGCCTCAGCAGCACCCTGACGCTGAG

CAAAGCAGACTACGAGAAACACAAAGTCTACGCCTGCGAAGTCACCCATCAGGGCCTGAGCTCGCCC

GTCACAAAGAGCTTCAACAGGGGAGAGTGC

1015 Heavy chain nt sequence
(SEQ ID NO: 5757)
GAGGTGCAGCTGGTGGAGTCCGGGGGAGGCTTAGTTCAGCCTGGGGGGTCCCTGAGACTCTCCTGTGC

AGCCTCTGGATTCACCTTCAGTAGCTACTGGATGCACTGGGTCCGCCAAGCTCCAGGGAAGGGGCTGG

TGTGGGTCTCACATATTAATAGTGATGGGAGTAGCACAGAGCTACGCGGACTCCGTGAAGGGCCGATTC

ACCATCTCCAGAGACAACGCCAAGAACACGCTGTATCTGCAAATGAACAGTCTGAGAGCCGAGGACA

CGGCTGTGTATTACTGTGCAAGAGGCTTACGATATTTTGACCTGGACGTCTGGGGCCAAGGGACCACG

GTCACCGTCTCCTCAGCCTCCACCAAGGGCCCATCGGTCTTCCCCCTGGCACCCTCCTCCAAGAGCACC

TCTGGGGGCACAGCGGCCCTGGGCTGCCTGGTCAAGGACTACTTCCCCGAACCGGTGACGGTGTCGTG

GAACTCAGGCGCACTGACCAGCGGCGTGCACACCTTCCCGGCTGTCCTACAGTCCTCAGGACTCTACT

CCCTCAGCAGCGTGGTGACCGTGCCCTCCAGCAGCTTGGGCACCCAGACCTACATCTGCAACGTGAAT

CACAAGCCCAGCAACACCAAGGTGGACAAGAGAGTTGAGCCCAAATCTTGTGACAAAACTCACACAT

GCCCACCGTGCCCAGCACCTGAACTCCTGGGGGGACCGTCAGTCTTCCTCTTCCCCCCAAAACCCAAG

GACACCCTCATGATCTCCCGGACCCCTGAGGTCACATGCGTGGTGGTGGACGTGAGCCACGAAGACCC

TGAGGTCAAGTTCAACTGGTATGTGGACGGCGTGGAGGTGCATAATGCCAAGACAAAGCCGCGGGAG

GAGCAGTACAACAGCACGTACCGTGTGGTCAGCGTCCTCACCGTCCTGCACCAAGACTGGCTGAATGG

CAAGGAGTACAAGTGCAAGGTCTCCAACAAAGCCCTCCCAGCCCCCATCGAGAAAACCATCTCCAAA

GCCAAAGGGCAGCCCCGAGAACCACAGGTGTACACCCTGCCCCCATCCCGGGAGGAGATGACCAAGA

ACCAAGTCAGCCTGACCTGCCTGGTCAAAGGCTTCTATCCCAGCGACATCGCCGTGGAGTGGGAGAGC

AATGGGCAGCCGGAGAACAACTACAAGACCACGCCTCCCGTGCTGGACTCCGACGGCTCCTTCTTCCT

CTATTCCAAGCTCACCGTGGACAAGAGCAGGTGGCAGCAGGGGAACGTCTTCTCATGCTCCGTGATGC

ATGAGGCTCTGCACAACCACTACACGCAGAAGAGCCTCTCCCTGTCTCCGGGCAAA

1015 Light chain nt sequence
(SEQ ID NO: 5758)
CAGTCTGTGCTGACTCAGCCACCCTCGGTGTCTGAAGCCCCCAGGCAGAGGGTCACCATCTCCTGTTCT

GGAAGCAGCTCCAACATCGGAAATAATGCTGTGAACTGGTACCAGCAGCTCCCAGGAAAGGCTCCCA

AACTCCTCATCTTTTATGATGATCTGCTGCCCTCAGGGGTCTCTGACCGATTCTCTGGCTCCAAGTCTG

GCACCTCAGCCTCCCTGGCCATCAGTGGGCTCCAGTCTGAGGATGAGGCTGATTATTACTGTGCAGCA

TGGGATGACAGCCTGAATGGTGGGGTGTTCGGCGGAGGGACCAAACTGACCGTCCTAGGCCAGCCCA

AGGCTGCCCCCTCGGTCACTCTGTTCCCGCCCTCCTCTGAGGAGCTTCAAGCCAACAAGGCCACACTG

GTGTGTCTCATAAGTGACTTCTACCCGGGAGCCGTGACAGTGGCCTGGAAGGCAGATAGCAGCCCCGT

CAAGGCGGGAGTGGAGACAACCACACCCTCCAAACAAAGCAACAACAAGTACGCGGCCAGCAGCTAT

CTGAGCCTGACGCCTGAGCAGTGGAAGTCCCACAGAAGCTACAGCTGCCAGGTCACGCATGAAGGGA

GCACCGTGGAGAAGACAGTGGCCCCTACAGAATGTTCA

-continued

1036 Heavy chain nt sequence
(SEQ ID NO: 5759)
CAGGTCCAGCTGGTGCAGTCTGGGGCTGAGGTGAAGAAGCCTGGGTCCTCGGTGAAGGTCTCCTGCAA

GGCTTCTGGAGGCACCTTGAGCAGCTATACTATCAGCTGGGTGCGACAGGCCCCTGGACAAGGGCTTG

AGTGGATGGGAAGGATCATCCCTATCCTTGGTATAGCAGACTACGCACAGAAGTTCCAGGGCAGAGTC

ACGATTACCGCGGACAAATCCACGACCACAGCCTACATGGATCTGAGCAGCCTGGGATCTGAGGACA

CGGCCTTGTATTATTGTGCGAGTGCTCCGAAGGATTGGAGCTCCGGTTTTGACTACTACTACGGTATGG

ACGTCTGGGGCCAAGGGACCATGGTCACCGTCTCCTCAGCCTCCACCAAGGGCCCATCGGTCTTCCCC

CTGGCACCCTCCTCCAAGAGCACCTCTGGGGGCACAGCGGCCCTGGGCTGCCTGGTCAAGGACTACTT

CCCCGAACCGGTGACGGTGTCGTGGAACTCAGGCGCACTGACCAGCGGCGTGCACACCTTCCCGGCTG

TCCTACAGTCCTCAGGACTCTACTCCCTCAGCAGCGTGGTGACCGTGCCCTCCAGCAGCTTGGGCACCC

AGACCTACATCTGCAACGTGAATCACAAGCCCAGCAACACCAAGGTGGACAAGAGAGTTGAGCCCAA

ATCTTGTGACAAAACTCACACATGCCCACCGTGCCCAGCACCTGAACTCCTGGGGGGACCGTCAGTCT

TCCTCTTCCCCCCAAAACCCAAGGACACCCTCATGATCTCCCGGACCCCTGAGGTCACATGCGTGGTG

GTGGACGTGAGCCACGAAGACCCTGAGGTCAAGTTCAACTGGTATGTGGACGGCGTGGAGGTGCATA

ATGCCAAGACAAAGCCGCGGGAGGAGCAGTACAACAGCACGTACCGTGTGGTCAGCGTCCTCACCGT

CCTGCACCAAGACTGGCTGAATGGCAAGGAGTACAAGTGCAAGGTCTCCAACAAAGCCCTCCCAGCC

CCCATCGAGAAAACCATCTCCAAAGCCAAAGGGCAGCCCCGAGAACCACAGGTGTACACCCTGCCCC

CATCCCGGGAGGAGATGACCAAGAACCAAGTCAGCCTGACCTGCCTGGTCAAAGGCTTCTATCCCAGC

GACATCGCCGTGGAGTGGGAGAGCAATGGGCAGCCGGAGAACAACTACAAGACCACGCCTCCCGTGC

TGGACTCCGACGGCTCCTTCTTCCTCTATTCCAAGCTCACCGTGGACAAGAGCAGGTGGCAGCAGGGG

AACGTCTTCTCATGCTCCGTGATGCATGAGGCTCTGCACAACCACTACACGCAGAAGAGCCTCTCCCT

GTCTCCGGGCAAA

1036 Light chain nt sequence
(SEQ ID NO: 5760)
GATATTGTGATGACCCAGACTCCACTCTCTCTGTCCGTCACCCCTGGACAGCCGGCCTCCATCTCCTGC

AAGTCTAGTCAGAGCCTCCTGAATAGTGATGGAAAGACCTATTTGTATTGGTACCTGCAGAAGGCAGG

CCAGCCTCCACAGCTCCTGATCTATGAAGTTTCCAACCGGTTCTCTGGAGTGCCAGAAAGGTTCAGTG

GCAGCGGGTCAGGGACAGATTTCACACTGAAAATCAGCCGGGTGGAGGCTGAGGATGTTGGGGTTTA

CTACTGCATGCAAAGTGTACAACTTCCTCCGTACACTTTTGGCCAGGGCACCAAGCTGGAGATCACAA

GAACTGTGGCGGCCGCCATCTGTCTTCATCTTCCCGCCATCTGATGAGCAGTTGAAATCCGGAACTGCCT

CTGTTGTGTGCCTGCTGAATAACTTCTATCCCAGAGAGGCCAAAGTACAGTGGAAGGTGGATAACGCC

CTCCAATCGGGTAACTCCCAGGAGAGTGTCACAGAGCAGGACAGCAAGGACAGCACCTACAGCCTCA

GCAGCACCCTGACGCTGAGCAAAGCAGACTACGAGAAACACAAAGTCTACGCCTGCGAAGTCACCCA

TCAGGGCCTGAGCTCGCCCGTCACAAAGAGCTTCAACAGGGGAGAGTGC

1037 Heavy chain nt sequence
(SEQ ID NO: 5761)
CAGATCACCTTGAAGGAGTCTGGTCCTACGCTGGTGAAACCCACACAGACCCTCACGCTGACCTGCAC

CTTCTCTGGGTTCTCACTCAGCACTAGTGGAGTGGGTGTGGGCTGGATCCGTCAGCCCCCAGGAAAGG

CCCTGGAGTGGCTTGCACTCATTTATTGGGATGATGATAAGCGCTACAGCCCATCTCTGAAGAGCAGG

CTCACCATCACCAAGGACACCTCCAAAAACCAGGTGGTCCTTACAATGACCAACATGGACCCTGTGGA

CACAGCCACATATTACTGTGCACACCATACGATAACTCGGATAAATGACTACTGGGGCCAGGGAACCC

TGGTCACCGTCTCCTCAGCCTCCACCAAGGGCCCATCGGTCTTCCCCCTGGCACCCTCCTCCAAGAGCA

CCTCTGGGGCACAGCGGCCCTGGGCTGCCTGGTCAAGGACTACTTCCCCGAACCGGTGACGGTGTCG

TGGAACTCAGGCGCACTGACCAGCGGCGTGCACACCTTCCCGGCTGTCCTACAGTCCTCAGGACTCTA

CTCCCTCAGCAGCGTGGTGACCGTGCCCTCCAGCAGCTTGGGCACCCAGACCTACATCTGCAACGTGA

ATCACAAGCCCAGCAACACCAAGGTGGACAAGAGAGTTGAGCCCAAATCTTGTGACAAAACTCACAC

ATGCCCACCGTGCCCAGCACCTGAACTCCTGGGGGGACCGTCAGTCTTCCTCTTCCCCCCAAAACCCA

AGGACACCCTCATGATCTCCCGGACCCCTGAGGTCACATGCGTGGTGGTGGACGTGAGCCACGAAGAC

CCTGAGGTCAAGTTCAACTGGTATGTGGACGGCGTGGAGGTGCATAATGCCAAGACAAAGCCGCGGG

AGGAGCAGTACAACAGCACGTACCGTGTGGTCAGCGTCCTCACCGTCCTGCACCAAGACTGGCTGAAT

GGCAAGGAGTACAAGTGCAAGGTCTCCAACAAAGCCCTCCCAGCCCCCATCGAGAAAACCATCTCCA

AAGCCAAAGGGCAGCCCCGAGAACCACAGGTGTACACCCTGCCCCCATCCCGGGAGGAGATGACCAA

GAACCAAGTCAGCCTGACCTGCCTGGTCAAAGGCTTCTATCCCAGCGACATCGCCGTGGAGTGGGAGA

GCAATGGGCAGCCGGAGAACAACTACAAGACCACGCCTCCCGTGCTGGACTCCGACGGCTCCTTCTTC

CTCTATTCCAAGCTCACCGTGGACAAGAGCAGGTGGCAGCAGGGGAACGTCTTCTCATGCTCCGTGAT

GCATGAGGCTCTGCACAACCACTACACGCAGAAGAGCCTCTCCCTGTCTCCGGGCAAA

1037 Light chain nt sequence (SEQ ID NO: 5762)

CAGTCTGCCCTGACTCAGCCTGCCTCCGTGTCTGGGTCTCCTGGACAGTCGATCACCATCTCCTGCACT

GCAACCAGCAGTGACGTTGGTGCTTATAACTATGTCCTGGTACCAACAACACCCAGGCAAAGCCCC

CAAACTCATGATTTATGATGTCAGTAAGCGGCCCTCAGGGGTTTCTAATCGCTTCTCTGGCTCCAAGTC

TGGCAACACGGCCTCCCTGACCATCTCTGGGCTCCAGGCTGAGGACGAGGCTGATTATTACTGCAGCT

CATACACAAGCAGCAGCACGGTGTTCGGCGGAGGGACCAAGTTGACCGTCCTAGGCCAGCCCAAGGC

TGCCCCCTCGGTCACTCTGTTCCCGCCCTCCTCTGAGGAGCTTCAAGCCAACAAGGCCACACTGGTGTG

TCTCATAAGTGACTTCTACCCGGGAGCCGTGACAGTGGCCTGGAAGGCAGATAGCAGCCCCGTCAAGG

CGGGAGTGGAGACAACCACACCCTCCAAACAAAGCAACAACAAGTACGCGGCCAGCAGCTATCTGAG

CCTGACGCCTGAGCAGTGGAAGTCCCACAGAAGCTACAGCTGCCAGGTCACGCATGAAGGGAGCACC

GTGGAGAAGACAGTGGCCCCTACAGAATGTTCA

1075 Heavy chain nt sequence (SEQ ID NO: 5763)

CAGGTCCAGCTGGTACAGTCTGGGGCTGAGGTGAAGAAGCCTGGGGCCTCAGTGAAGGTCTCCTGCAA

GGTTTCCGGATACACCCTCATTGAATTATCCATGCACTGGGTGCGACAGGCTCCTGGAAAAGGGCTTG

AGTGGATGGGAGGTTTTGATCCTGAAGATGGTGAAACAATCTACGCACAGAAGTTCCAGGGCAGAGT

CACCATGACCGAGGACACATCTACAGACACAGCCTACATGGAGCTGAGCAGCCTGAGATCTGAGGAC

ACGGCCGTGTATTACTGTGCAACAGAGTGGGCCTACTATGGTTCGGGGAGTTATTTGGGTTACTGGGG

CCAGGGAACCCTGGTCACCGTCTCCTCAGCCTCCACCAAGGGCCCATCGGTCTTCCCCCTGGCACCCTC

CTCCAAGAGCACCTCTGGGGGCACAGCGGCCCTGGGCTGCCTGGTCAAGGACTACTTCCCCGAACCGG

TGACGGTGTCGTGGAACTCAGGCGCACTGACCAGCGGCGTGCACACCTTCCCGGCTGTCCTACAGTCC

TCAGGACTCTACTCCCTCAGCAGCGTGGTGACCGTGCCCTCCAGCAGCTTGGGCACCCAGACCTACAT

CTGCAACGTGAATCACAAGCCCAGCAACACCAAGGTGGACAAGAGAGTTGAGCCCAAATCTTGTGAC

AAAACTCACACATGCCCACCGTGCCCAGCACCTGAACTCCTGGGGGGACCGTCAGTCTTCCTCTTCCCC

CCAAAACCCAAGGACACCCTCATGATCTCCCGGACCCCTGAGGTCACATGCGTGGTGGTGGACGTGAG

CCACGAAGACCCTGAGGTCAAGTTCAACTGGTATGTGGACGGCGTGGAGGTGCATAATGCCAAGACA

AAGCCGCGGGAGGAGCAGTACAACAGCACGTACCGTGTGGTCAGCGTCCTCACCGTCCTGCACCAAG

ACTGGCTGAATGGCAAGGAGTACAAGTGCAAGGTCTCCAACAAAGCCCTCCCAGCCCCCATCGAGAA

-continued

```
AACCATCTCCAAAGCCAAAGGGCAGCCCCGAGAACCACAGGTGTACACCCTGCCCCCATCCCGGGAG

GAGATGACCAAGAACCAAGTCAGCCTGACCTGCCTGGTCAAAGGCTTCTATCCCAGCGACATCGCCGT

GGAGTGGGAGAGCAATGGGCAGCCGGAGAACAACTACAAGACCACGCCTCCCGTGCTGGACTCCGAC

GGCTCCTTCTTCCTCTATTCCAAGCTCACCGTGGACAAGAGCAGGTGGCAGCAGGGGAACGTCTTCTC

ATGCTCCGTGATGCATGAGGCTCTGCACAACCACTACACGCAGAAGAGCCTCTCCCTGTCTCCGGGCA

AA
```

1075 Light chain nt sequence (SEQ ID NO: 5764)
```
GAAATAGTGATGACGCAGTCTCCAGCCACCCTGTCTGTGTCTCCAGGGGAAAGAGCCACCCTCTCCTG

CAGGGCCAGTCAGAGTGTTAGCAGCAACTTAGCCTGGTTCCAGCAGAAACCTGGCCAGGCTCCCAGGC

TCCTCATCTATGGTGCATCCACCAGGGTCACTGTTATCCCAGCCAGGTTCAGTGGCAGTGGGTCTGGGA

CAGAGTTCACTCTCACCATCAGCAGCCTGCAGTCTGAAGATTTTGCAGTTTATTACTGTCAGCAGTATA

ATAACTGGCCTCGGACGTTCGGCCAAGGGACCAAGGTGGAAATCAAAAGAACTGTGGCGGCGCCATC

TGTCTTCATCTTCCCGCCATCTGATGAGCAGTTGAAATCCGGAACTGCCTCTGTTGTGTGCCTGCTGAA

TAACTTCTATCCCAGAGAGGCCAAAGTACAGTGGAAGGTGGATAACGCCCTCCAATCGGGTAACTCCC

AGGAGAGTGTCACAGAGCAGGACAGCAAGGACAGCACCTACAGCCTCAGCAGCACCCTGACGCTGAG

CAAAGCAGACTACGAGAAACACAAAGTCTACGCCTGCGAAGTCACCCATCAGGGCCTGAGCTCGCCC

GTCACAAAGAGCTTCAACAGGGGAGAGTGC
```

1130 Heavy chain nt sequence (SEQ ID NO: 5765)
```
CAGGTCCAGCTGGTGCAATCTGGGGCTGAGGTGAAGAAGCCTGGGTCCTCGGTGAAGGTCTCCTGCAA

GGCTTCTGGAGGCACCTTCAGCAGTAATACTATCAGCTGGGTGCGACAGGCCCCTGGACAAGGGCTTG

AGTGGATGGGAAGGATCATCCCTCTCCTTGGCACAGTAAACTACGCACAGAAGTTCCAGGGCAGAGTC

ACGATTACCGCGGACAAATCCACGACCACAGCCTACATGGAGCTGAGCAGCCTGAGATCTGAGGACA

CGGCCGTGTATTACTGTGCGAGAGATGCTGGGGGTATTACGATTTTTGGAGTGGAACACTACTACTAC

TACATGGACGTCTGGGGCAAAGGGACCACGGTCACCGTCACGTCAGCCTCCACCAAGGGCCCATCGGT

CTTCCCCCTGGCACCCTCCTCCAAGAGCACCTCTGGGGGCACAGCGGCCCTGGGCTGCCTGGTCAAGG

ACTACTTCCCCGAACCGGTGACGGTGTCGTGGAACTCAGGCGCACTGACCAGCGGCGTGCACACCTTC

CCGGCTGTCCTACAGTCCTCAGGACTCTACTCCCTCAGCAGCGTGGTGACCGTGCCCTCCAGCAGCTTG

GGCACCCAGACCTACATCTGCAACGTGAATCACAAGCCCAGCAACACCAAGGTGGACAAGAGAGTTG

AGCCCAAATCTTGTGACAAAACTCACACATGCCCACCGTGCCCAGCACCTGAACTCCTGGGGGGACCG

TCAGTCTTCCTCTTCCCCCCAAAACCCAAGGACACCCTCATGATCTCCCGGACCCCTGAGGTCACATGC

GTGGTGGTGGACGTGAGCCACGAAGACCCTGAGGTCAAGTTCAACTGGTATGTGGACGGCGTGGAGG

TGCATAATGCCAAGACAAAGCCGCGGGAGGAGCAGTACAACAGCACGTACCGTGTGGTCAGCGTCCT

CACCGTCCTGCACCAAGACTGGCTGAATGGCAAGGAGTACAAGTGCAAGGTCTCCAACAAAGCCCTCC

CAGCCCCCATCGAGAAAACCATCTCCAAAGCCAAAGGGCAGCCCCGAGAACCACAGGTGTACACCCT

GCCCCCATCCCGGGAGGAGATGACCAAGAACCAAGTCAGCCTGACCTGCCTGGTCAAAGGCTTCTATC

CCAGCGACATCGCCGTGGAGTGGGAGAGCAATGGGCAGCCGGAGAACAACTACAAGACCACGCCTCC

CGTGCTGGACTCCGACGGCTCCTTCTTCCTCTATTCCAAGCTCACCGTGGACAAGAGCAGGTGGCAGC

AGGGGAACGTCTTCTCATGCTCCGTGATGCATGAGGCTCTGCACAACCACTACACGCAGAAGAGCCTC

TCCCTGTCTCCGGGCAAA
```

-continued

1130 Light chain nt sequence
(SEQ ID NO: 5766)
GAAATTGTGTTGACGCAGTCTCCAGGCACCCTGTCTTTGTCTCCAGGGGAAAGAGCCACCCTCTCCTGC

AGGGCCAGTCAGAGTGTTAGCAGCAGCCACTTAGCCTGGTACCAGCAGAAACCTGGCCAGGCTCCCA

GGCTCCTCATCTATGATGCATCCAGCAGGGCCACTGGCATCCCAGACAGGTTCAGTGGCAGTGGGTCT

GGGACAGACTTCACTCTCACCATCAGCAGACTGGAGCCTGAAGATTTTGCAGTGTATTACTGTCAGCA

GTATGGTAGCTCACCTCCGATGTACACTTTTGGCCAGGGGACCAAGCTGGAGATCAAAAGAACTGTGG

CGGCGCCATCTGTCTTCATCTTCCCGCCATCTGATGAGCAGTTGAAATCCGGAACTGCCTCTGTTGTGT

GCCTGCTGAATAACTTCTATCCCAGAGAGGCCAAAGTACAGTGGAAGGTGGATAACGCCCTCCAATCG

GGTAACTCCCAGGAGAGTGTCACAGAGCAGGACAGCAAGGACAGCACCTACAGCCTCAGCAGCACCC

TGACGCTGAGCAAAGCAGACTACGAGAAACACAAAGTCTACGCCTGCGAAGTCACCCATCAGGGCCT

GAGCTCGCCCGTCACAAAGAGCTTCAACAGGGGAGAGTGC

1135 Heavy chain nt sequence
(SEQ ID NO: 5767)
GAAGTGCAGCTGGTGGAGTCTGGGGGAGGCTTGGTACAGCCTGGCAGGTCCCTGAGACTCTCCTGTGC

AGCCTCTGGACTCACCTTTGAGGATTATGCCATGCACTGGGTCCGGCAAGTTCCAGGGAAGGGCCTGG

AGTGGGTCTCAGGTATTAGTTGGAATAGTGGTACCATAGGCTATGCGGACTCTGTGAAGGGCCGATTC

ATCATCTCCAGAGACAACGCCAAGAACTCCCTGTATCTGCAAATGAGAAGTCTGAGAGCTGAGGACAC

GGCCTTGTATTACTGTGCAAAAGATGTGGGGTTCGGGGAGTTATTATACTATGCTTTTGATATCTGGGG

CCAAGGGACAATGGTCACCGTCTCTTCAGCCTCCACCAAGGGCCCATCGGTCTTCCCCCTGGCACCCTC

CTCCAAGAGCACCTCTGGGGGCACAGCGGCCCTGGGCTGCCTGGTCAAGGACTACTTCCCCGAACCGG

TGACGGTGTCGTGGAACTCAGGCGCACTGACCAGCGGCGTGCACACCTTCCCGGCTGTCCTACAGTCC

TCAGGACTCTACTCCCTCAGCAGCGTGGTGACCGTGCCCTCCAGCAGCTTGGGCACCCAGACCTACAT

CTGCAACGTGAATCACAAGCCCAGCAACACCAAGGTGGACAAGAGAGTTGAGCCCAAATCTTGTGAC

AAAACTCACACATGCCCACCGTGCCCAGCACCTGAACTCCTGGGGGGACCGTCAGTCTTCCTCTTCCCC

CCAAAACCCAAGGACACCCTCATGATCTCCCGGACCCCTGAGGTCACATGCGTGGTGGTGGACGTGAG

CCACGAAGACCCTGAGGTCAAGTTCAACTGGTATGTGGACGGCGTGGAGGTGCATAATGCCAAGACA

AAGCCGCGGGAGGAGCAGTACAACAGCACGTACCGTGTGGTCAGCGTCCTCACCGTCCTGCACCAAG

ACTGGCTGAATGGCAAGGAGTACAAGTGCAAGGTCTCCAACAAAGCCCTCCCAGCCCCCATCGAGAA

AACCATCTCCAAAGCCAAAGGGCAGCCCCGAGAACCACAGGTGTACACCCTGCCCCCATCCCGGGAG

GAGATGACCAAGAACCAAGTCAGCCTGACCTGCCTGGTCAAAGGCTTCTATCCCAGCGACATCGCCGT

GGAGTGGGAGAGCAATGGGCAGCCGGAGAACAACTACAAGACCACGCCTCCCGTGCTGGACTCCGAC

GGCTCCTTCTTCCTCTATTCCAAGCTCACCGTGGACAAGAGCAGGTGGCAGCAGGGGAACGTCTTCTC

ATGCTCCGTGATGCATGAGGCTCTGCACAACCACTACACGCAGAAGAGCCTCTCCCTGTCTCCGGGCA

AA

1135 Light chain nt sequence
(SEQ ID NO: 5768)
CAGTCTGCCCTGACTCAGCCTGCCTCCGTGTCCGGGTCTCCTGGACAGTCGATCACCATCTCCTGCACT

GGAACCAGCAGTGACGTTGGTGGTTATAACTATGTCTCCTGGTACCAACAACACCCAGGCAAAGCCCC

CAAACTCATGATTTATGATGTCAGTAATCGGCCCTCAGGGGTTTCTAATCGCTTCTCTGGCTCCAAGTC

TGGCAACACGGCCTCCCTGACCATCTCTGGGCTCCAGGCTGAGGACGAGGCTGATTATTACTGCAGCT

CATATACAAGCAGCAGCACTGTGGTATTCGGCGGAGGGACCAAGCTGACCGTCCTAGGCCAGCCCAA

GGCTGCCCCCTCGGTCACTCTGTTCCCGCCCTCCTCTGAGGAGCTTCAAGCCAACAAGGCCACACTGGT

```
GTGTCTCATAAGTGACTTCTACCCGGGAGCCGTGACAGTGGCCTGGAAGGCAGATAGCAGCCCCGTCA

AGGCGGGAGTGGAGACAACCACACCCTCCAAACAAAGCAACAACAAGTACGCGGCCAGCAGCTATCT

GAGCCTGACGCCTGAGCAGTGGAAGTCCCACAGAAGCTACAGCTGCCAGGTCACGCATGAAGGGAGC

ACCGTGGAGAAGACAGTGGCCCCTACAGAATGTTCA
```

1139 Heavy chain nt sequence
(SEQ ID NO: 5769)
```
CAGGTGCAGCTGGTGCAGTCTGGGGCTGAGGTGAAGAAGCCTGGGGCCTCAGTGAAGGTCTCCTGCA

AGGCTTCTGGATACACCTTCAGCAGTTATGAAATCAATTGGGTGCGACAGGCCACTGGACAAGGGCTT

GAGTGGATGGGACGGATGACTCTTAACAGTGGTAACACAGGCTATGCACAGAACTTCCAGGGCAGAG

TCACTATGACCAGGGACACCTCCATAAGCACAGCCTACATGGAGCTGAGCGGCCTGAGATCTGAGGAC

ACGGCCGTGTATTACTGTGCGAGAATGCGCAGTGGCTGGCCCACACATGGCCGCCCGGATGACTACTG

GGGCCAAGGAACCCTGGTCACCGTCTCCTCAGCCTCCACCAAGGGCCCATCGGTCTTCCCCCTGGCAC

CCTCCTCCAAGAGCACCTCTGGGGGCACAGCGGCCCTGGGCTGCCTGGTCAAGGACTACTTCCCCGAA

CCGGTGACGGTGTCGTGGAACTCAGGCGCACTGACCAGCGGCGTGCACACCTTCCCGGCTGTCCTACA

GTCCTCAGGACTCTACTCCCTCAGCAGCGTGGTGACCGTGCCCTCCAGCAGCTTGGGCACCCAGACCT

ACATCTGCAACGTGAATCACAAGCCCAGCAACACCAAGGTGGACAAGAGAGTTGAGCCCAAATCTTG

TGACAAAACTCACACATGCCCACCGTGCCCAGCACCTGAACTCCTGGGGGGACCGTCAGTCTTCCTCT

TCCCCCCAAAACCCAAGGACACCCTCATGATCTCCCGGACCCCTGAGGTCACATGCGTGGTGGTGGAC

GTGAGCCACGAAGACCCTGAGGTCAAGTTCAACTGGTATGTGGACGGCGTGGAGGTGCATAATGCCA

AGACAAAGCCGCGGGAGGAGCAGTACAACAGCACGTACCGTGTGGTCAGCGTCCTCACCGTCCTGCA

CCAAGACTGGCTGAATGGCAAGGAGTACAAGTGCAAGGTCTCCAACAAAGCCCTCCCAGCCCCCATC

GAGAAAACCATCTCCAAAGCCAAAGGGCAGCCCCGAGAACCACAGGTGTACACCCTGCCCCCATCCC

GGGAGGAGATGACCAAGAACCAAGTCAGCCTGACCTGCCTGGTCAAAGGCTTCTATCCCAGCGACATC

GCCGTGGAGTGGGAGAGCAATGGGCAGCCGGAGAACAACTACAAGACCACGCCTCCCGTGCTGGACT

CCGACGGCTCCTTCTTCCTCTATTCCAAGCTCACCGTGGACAAGAGCAGGTGGCAGCAGGGGAACGTC

TTCTCATGCTCCGTGATGCATGAGGCTCTGCACAACCACTACACGCAGAAGAGCCTCTCCCTGTCTCCG

GGCAAA
```

1139 Light chain nt sequence
(SEQ ID NO: 5770)
```
CAGTCTGTGCTGACTCAGCCACCCTCAGCGTCTGGGACCCCCGGGCAGAGGGTCACCATCTCTTGTTCT

GGAAGTAACTCCAATATCGGAAGTTATACTGTAAACTGGTACCAGCAACTCCCAGGAACGGCCCCCAA

ACTGCTCATCTATGGTAATAATCAGCGGCCCTCAGGGGTCCCTGACCGATTCTCTGGCTCCAAGTCTGG

GACCTCAGCCTCCCTGGCCATCAGTGGCCTCCAGTCTGAGGATGAGGCTGATTATTACTGTTTGGCATG

GGATGACAGCCGGAATGGCCTGGTATTCGGCGGAGGGACCAAGCTGACCGTCCTAGGCCAGCCCAAG

GCTGCCCCCTCGGTCACTCTGTTCCCGCCCTCCTCTGAGGAGCTTCAAGCCAACAAGGCCACACTGGTG

TGTCTCATAAGTGACTTCTACCCGGGAGCCGTGACAGTGGCCTGGAAGGCAGATAGCAGCCCCGTCAA

GGCGGGAGTGGAGACAACCACACCCTCCAAACAAAGCAACAACAAGTACGCGGCCAGCAGCTATCTG

AGCCTGACGCCTGAGCAGTGGAAGTCCCACAGAAGCTACAGCTGCCAGGTCACGCATGAAGGGAGCA

CCGTGGAGAAGACAGTGGCCCCTACAGAATGTTCA
```

1149 Heavy chain nt sequence
(SEQ ID NO: 5771)
```
CAGGTGCAGCTGGTGCAGTCTGGGGCTGAGGTGAAGAAGCCTGGGGCCTCAGTGAAGGTCTCCTGCA

AGGCTTCTGGATACACCTTCGCCAGTTATGATATCAACTGGGTGCGACAGGCCACTGGACAAGGGCCT

GAGTGGATGGGATGGATGATCCCTAACATTGGTAACACAGGCTATGCACAGAAGTTCCAGGGCAGAG
```

-continued

TCACCATGACCAGGAACACCTCCATAAGCACAGCCTACATGGAGCTGAGCAGCCTGACATCTGAGGAC

ACGGCCGTGTATTACTGTGCGAGAGTTTCTAGGCTATTTAATGACTTCGGTCTAAGACATGAGGCACCC

GTTGACTTCTGGGGCCAGGGAACCCGGGTCACCGTCTCCTCAGCCTCCACCAAGGGCCCATCGGTCTT

CCCCCTGGCACCCTCCTCCAAGAGCACCTCTGGGGGCACAGCGGCCCTGGGCTGCCTGGTCAAGGACT

ACTTCCCCGAACCGGTGACGGTGTCGTGGAACTCAGGCGCACTGACCAGCGGCGTGCACACCTTCCCG

GCTGTCCTACAGTCCTCAGGACTCTACTCCCTCAGCAGCGTGGTGACCGTGCCCTCCAGCAGCTTGGGC

ACCCAGACCTACATCTGCAACGTGAATCACAAGCCCAGCAACACCAAGGTGGACAAGAGAGTTGAGC

CCAAATCTTGTGACAAAACTCACACATGCCCACCGTGCCCAGCACCTGAACTCCTGGGGGGACCGTCA

GTCTTCCTCTTCCCCCCAAAACCCAAGGACACCCTCATGATCTCCCGGACCCCTGAGGTCACATGCGTG

GTGGTGGACGTGAGCCACGAAGACCCTGAGGTCAAGTTCAACTGGTATGTGGACGGCGTGGAGGTGC

ATAATGCCAAGACAAAGCCGCGGGAGGAGCAGTACAACAGCACGTACCGTGTGGTCAGCGTCCTCAC

CGTCCTGCACCAAGACTGGCTGAATGGCAAGGAGTACAAGTGCAAGGTCTCCAACAAAGCCCTCCCA

GCCCCCATCGAGAAAACCATCTCCAAAGCCAAAGGGCAGCCCCGAGAACCACAGGTGTACACCCTGC

CCCCATCCCGGGAGGAGATGACCAAGAACCAAGTCAGCCTGACCTGCCTGGTCAAAGGCTTCTATCCC

AGCGACATCGCCGTGGAGTGGGAGAGCAATGGGCAGCCGGAGAACAACTACAAGACCACGCCTCCCG

TGCTGGACTCCGACGGCTCCTTCTTCCTCTATTCCAAGCTCACCGTGGACAAGAGCAGGTGGCAGCAG

GGGAACGTCTTCTCATGCTCCGTGATGCATGAGGCTCTGCACAACCACTACACGCAGAAGAGCCTCTC

CCTGTCTCCGGGCAAA

1149 Light chain nt sequence
(SEQ ID NO: 5772)
CAGTCTGTGCTGACGCAGCCGCCCTCAGTGTCTGGGGCCCCAGGGCAGAGGGTCACCATCTCCTGCAC

TGGGAGCAGCTCCAACATCGGGGCAGGTTATGATGTACACTGGTACCAGCAGCTTCCAGGAACAGCCC

CCAAACTCCTCATCTATGGTTACAGCAGTCGGCCCTCAGGGGTCCCTGACCGATTCTCTGGCTCCAAGT

CTGGCACCTCAGCCTCCCTGGCCATCACTGGGCTCCAGGCTGAGGATGAGGCTGATTATTACTGCCAG

TCCTATGACAGCAGCCTGAGTGTTTTATTCGGCGGAGGGACCAAGCTGACCGTCCTAGGCCAGCCCAA

GGCTGCCCCCTCGGTCACTCTGTTCCCGCCCTCCTCTGAGGAGCTTCAAGCCAACAAGGCCACACTGGT

GTGTCTCATAAGTGACTTCTACCCGGGAGCCGTGACAGTGGCCTGGAAGGCAGATAGCAGCCCCGTCA

AGGCGGGAGTGGAGACAACCACACCCTCCAAACAAAGCAACAACAAGTACGCGGCCAGCAGCTATCT

GAGCCTGACGCCTGAGCAGTGGAAGTCCCACAGAAGCTACAGCTGCCAGGTCACGCATGAAGGGAGC

ACCGTGGAGAAGACAGTGGCCCCTACAGAATGTTCA

1404 Heavy chain nt sequence
(SEQ ID NO: 5773)
CAGATCACCTTGAAGGAGTCTGGTCCTACGCTGGTGAAACCCACACAGACCCTCACGCTGACCTGCAC

CTTCTCTGGGTTCTCACTCAGCATTAGTGGAGTGGGTGTGGGCTGGCTCCGTCAGCCCCCAGGAAAGG

CCCTGGAGTGGCTTGCACTCATTTATTGGGATGATGATAAGCGCTACAGCCCATCTCTGAAGAGCAGG

CTCACCATCAGCAAGGACACCTCCAAAAACCAGGTGGTCCTTAAAATGACCAACATTGACCCTGTGGA

CACAGCCACATATTACTGTGCACACCATTCGATTAGCACCATCTTTGACCACTGGGCCAGGGAACCC

TGGTCACCGTCTCCTCAGCCTCCACCAAGGGCCCATCGGTCTTCCCCCTGGCACCCTCCTCCAAGAGCA

CCTCTGGGGGCACAGCGGCCCTGGGCTGCCTGGTCAAGGACTACTTCCCCGAACCGGTGACGGTGTCG

TGGAACTCAGGCGCACTGACCAGCGGCGTGCACACCTTCCCGGCTGTCCTACAGTCCTCAGGACTCTA

CTCCCTCAGCAGCGTGGTGACCGTGCCCTCCAGCAGCTTGGGCACCCAGACCTACATCTGCAACGTGA

ATCACAAGCCCAGCAACACCAAGGTGGACAAGAGAGTTGAGCCCAAATCTTGTGACAAAACTCACAC

-continued

ATGCCCACCGTGCCCAGCACCTGAACTCCTGGGGGACCGTCAGTCTTCCTCTTCCCCCCAAAACCCA
AGGACACCCTCATGATCTCCCGGACCCCTGAGGTCACATGCGTGGTGGTGGACGTGAGCCACGAAGAC
CCTGAGGTCAAGTTCAACTGGTATGTGGACGGCGTGGAGGTGCATAATGCCAAGACAAAGCCGCGGG
AGGAGCAGTACAACAGCACGTACCGTGTGGTCAGCGTCCTCACCGTCCTGCACCAAGACTGGCTGAAT
GGCAAGGAGTACAAGTGCAAGGTCTCCAACAAAGCCCTCCCAGCCCCCATCGAGAAAACCATCTCCA
AAGCCAAAGGGCAGCCCCGAGAACCACAGGTGTACACCCTGCCCCCATCCCGGGAGGAGATGACCAA
GAACCAAGTCAGCCTGACCTGCCTGGTCAAAGGCTTCTATCCCAGCGACATCGCCGTGGAGTGGGAGA
GCAATGGGCAGCCGGAGAACAACTACAAGACCACGCCTCCCGTGCTGGACTCCGACGGCTCCTTCTTC
CTCTATTCCAAGCTCACCGTGGACAAGAGCAGGTGGCAGCAGGGGAACGTCTTCTCATGCTCCGTGAT
GCATGAGGCTCTGCACAACCACTACACGCAGAAGAGCCTCTCCCTGTCTCCGGGCAAA

1404 Light chain nt sequence
(SEQ ID NO: 5774)
CAGTCTGCCCTGACTCAGCCTGCCTCCGTGTCTGGGTCTCCTGGACAGTCGATCACCATCTCCTGCACT
GCAACCAGCAGTGACGTTGGTGATTATAACTATGTCTCCTGGTACCAACAACACCCAGGCAAAGCCCC
CAAACTCATGATTTTTGAGGTCAGTGATCGGCCCTCGGGGATTTCTAATCGCTTCTCTGGCTCCAAGTC
TGGCAACACGGCCTCCCTGACCATCTCTGGGCTCCAGGCTGAGGACGAGGCTGATTATTACTGCAGCT
CATATACAACCAGCAGCGCTGTATTCGGCGGAGGGACCAAGCTGACCGTCCTAGGCCAGCCCAAGGCT
GCCCCCTCGGTCACTCTGTTCCCGCCCTCCTCTGAGGAGCTTCAAGCCAACAAGGCCACACTGGTGTGT
CTCATAAGTGACTTCTACCCGGGAGCCGTGACAGTGGCCTGGAAGGCAGATAGCAGCCCCGTCAAGGC
GGGAGTGGAGACAACCACACCCTCCAAACAAAGCAACAACAAGTACGCGGCCAGCAGCTATCTGAGC
CTGACGCCTGAGCAGTGGAAGTCCCACAGAAGCTACAGCTGCCAGGTCACGCATGAAGGGAGCACCG
TGGAGAAGACAGTGGCCCCTACAGAATGTTCA 1444 Heavy chain nt sequence
(SEQ ID NO: 5775)
CAGGTGCAGCTGGTGCAGTCTGGGGCTGAGGTGAAGAAGCCTGGGGCCTCAGTGAAGGTCTCCTGCA
AGGCTTCTGGATACACCTTCACCGCCTACTATATGCACTGGGTGCGACAGGCCCCTGGACAAGGGCTT
GAGTGGATGGGCTGGATCAACCCTAACAGTGATGACACAAACTATGCACAGAAGTTTCAGGGCAGGG
TCACCATGACCAGGGACACGTCCATCAGTACAGCCTACATGGAGCTGAGCAGGCTGAGATCTGACGAC
ACGGCCGTCTATTACTGTGCGAGGGAAGAGGGAGTCTTCACAATCGGGGACCGATACTTCGATCTATG
GGGCCGTGGCACCCTGGTCAGTGTCTCCTCAGCCTCCACCAAGGGCCCATCGGTCTTCCCCCTGGCACC
CTCCTCCAAGAGCACCTCTGGGGGCACAGCGGCCCTGGGCTGCCTGGTCAAGGACTACTTCCCCGAAC
CGGTGACGGTGTCGTGGAACTCAGGCGCACTGACCAGCGGCGTGCACACCTTCCCGGCTGTCCTACAG
TCCTCAGGACTCTACTCCCTCAGCAGCGTGGTGACCGTGCCCTCCAGCAGCTTGGGCACCCAGACCTA
CATCTGCAACGTGAATCACAAGCCCAGCAACACCAAGGTGGACAAGAGAGTTGAGCCCAAATCTTGT
GACAAAACTCACACATGCCCACCGTGCCCAGCACCTGAACTCCTGGGGGGACCGTCAGTCTTCCTCTT
CCCCCCAAAACCCAAGGACACCCTCATGATCTCCCGGACCCCTGAGGTCACATGCGTGGTGGTGGACG
TGAGCCACGAAGACCCTGAGGTCAAGTTCAACTGGTATGTGGACGGCGTGGAGGTGCATAATGCCAA
GACAAAGCCGCGGGAGGAGCAGTACAACAGCACGTACCGTGTGGTCAGCGTCCTCACCGTCCTGCAC
CAAGACTGGCTGAATGGCAAGGAGTACAAGTGCAAGGTCTCCAACAAAGCCCTCCCAGCCCCCATCG
AGAAAACCATCTCCAAAGCCAAAGGGCAGCCCCGAGAACCACAGGTGTACACCCTGCCCCCATCCCG
GGAGGAGATGACCAAGAACCAAGTCAGCCTGACCTGCCTGGTCAAAGGCTTCTATCCCAGCGACATCG
CCGTGGAGTGGGAGAGCAATGGGCAGCCGGAGAACAACTACAAGACCACGCCTCCCGTGCTGGACTC
CGACGGCTCCTTCTTCCTCTATTCCAAGCTCACCGTGGACAAGAGCAGGTGGCAGCAGGGGAACGTCT -continued

TCTCATGCTCCGTGATGCATGAGGCTCTGCACAACCACTACACGCAGAAGAGCCTCTCCCTGTCTCCGG

GCAAA

1444 Light chain nt sequence
(SEQ ID NO: 5776)
CAGACTGTGGTGACCCAGGAGCCATCGTTCTCAGTGTCCCCTGGAGGGACAGTCACTCTCACTTGTGG

CTTGAGCTCTGGCTCAGTCTCTACTAGTTACTACCCCAGCTGGTACCAGCAGACCCCAGGCCAGGCTCC

ACGCACGCTCATCTACAACACAAACACTCGCTCTTCTGGGGTCCCTGATCGCTTCTCTGGCTCCATCCT

TGGGAACAAAGCTGCCCTCACCATCACGGGGGCCCAGGCAGATGATGAATCTGATTATTACTGTGTGC

TTTATATGGGTAGTGGCATTTGGGTGTTCGGCGGAGGGACCAAGCTGACCGTCCTAGGCCAGCCCAAG

GCTGCCCCCTCGGTCACTCTGTTCCCGCCCTCCTCTGAGGAGCTTCAAGCCAACAAGGCCACACTGGTG

TGTCTCATAAGTGACTTCTACCCGGGAGCCGTGACAGTGGCCTGGAAGGCAGATAGCAGCCCCGTCAA

GGCGGGAGTGGAGACAACCACACCCTCCAAACAAAGCAACAACAAGTACGCGGCCAGCAGCTATCTG

AGCCTGACGCCTGAGCAGTGGAAGTCCCACAGAAGCTACAGCTGCCAGGTCACGCATGAAGGGAGCA

CCGTGGAGAAGACAGTGGCCCCTACAGAATGTTCA

1495 Heavy chain nt sequence
(SEQ ID NO: 5777)
CAGGTGCAGCTGGTGGAGTCTGGGGGAGGCGTGGTCCAGCCTGGGAGGTCCCTGAGACTCTCCTGTAC

AGCCTCTGGATTCACCTTCAGTAGCTATGCTATGCACTGGGTCCGCCAGGCTCCAGGCAAGGGGCTGG

AGTGGGTGGCGGTTATATCGTATGATGGAAATAATAAATATTATGGAGACTCTGTGAAGGGCCGATTC

ACCATCTCCAGAGACAATTCCAAGAACACCCTGTATCTGCAGATGAACAGCCTGAGAGCTGAGGACAC

GGCTGTGTATTACTGCGCGAAAGGTGCCGACACCCCCATTATAGTGGCTATCATTTTTTGTCTGTCGG

CTACTACTTCTACGGTATGGACGTCTGGGGCCAAGGGACCACGGTCACCGTCTCCTCAGCCTCCACCA

AGGGCCCATCGGTCTTCCCCCTGGCACCCTCCTCCAAGAGCACCTCTGGGGGCACAGCGGCCCTGGGC

TGCCTGGTCAAGGACTACTTCCCCGAACCGGTGACGGTGTCGTGGAACTCAGGCGCACTGACCAGCGG

CGTGCACACCTTCCCGGCTGTCCTACAGTCCTCAGGACTCTACTCCCTCAGCAGCGTGGTGACCGTGCC

CTCCAGCAGCTTGGGCACCCAGACCTACATCTGCAACGTGAATCACAAGCCCAGCAACACCAAGGTGG

ACAAGAGAGTTGAGCCCAAATCTTGTGACAAAACTCACACATGCCCACCGTGCCCAGCACCTGAACTC

CTGGGGGGACCGTCAGTCTTCCTCTTCCCCCCAAAACCCAAGGACACCCTCATGATCTCCCGGACCCCT

GAGGTCACATGCGTGGTGGTGGACGTGAGCCACGAAGACCCTGAGGTCAAGTTCAACTGGTATGTGG

ACGGCGTGGAGGTGCATAATGCCAAGACAAAGCCGCGGGAGGAGCAGTACAACAGCACGTACCGTGT

GGTCAGCGTCCTCACCGTCCTGCACCAAGACTGGCTGAATGGCAAGGAGTACAAGTGCAAGGTCTCCA

ACAAAGCCCTCCCAGCCCCCATCGAGAAAACCATCTCCAAAGCCAAAGGGCAGCCCCGAGAACCACA

GGTGTACACCCTGCCCCCATCCCGGGAGGAGATGACCAAGAACCAAGTCAGCCTGACCTGCCTGGTCA

AAGGCTTCTATCCCAGCGACATCGCCGTGGAGTGGGAGAGCAATGGGCAGCCGGAGAACAACTACAA

GACCACGCCTCCCGTGCTGGACTCCGACGGCTCCTTCTTCCTCTATTCCAAGCTCACCGTGGACAAGAG

CAGGTGGCAGCAGGGGAACGTCTTCTCATGCTCCGTGATGCATGAGGCTCTGCACAACCACTACACGC

AGAAGAGCCTCTCCCTGTCTCCGGGCAAA

1495 Light chain nt sequence
(SEQ ID NO: 5778)
GACATCCAGATGACCCAGTCTCCATCCTCCCTGTCTGCATCTGTAGGAGACAGAGTCACCATCACTTGC

CGGGCAAGTCAGAGCATTAGCTACTATTTAAATTGGTATCAGCAGAAACCAGGGAAAGCCCCTCAGCT

CCTGATCTATGCTGCATCCAGTTTGCAAAGTGGGGTCCCATCAAGGTTCAGTGGCAGTAGATCTGGGA

CAGATTTCACTCTCACCATCAGCAGTCTGCAACCTGAAGACTTTGCAACTTATTACTGTCAACAGAGTT

-continued

ACAGTACTCCATTCACTTTCGGCCCTGGGACCAAAGTCGATATCAAAAGAACTGTGGCGGCGCCATCT

GTCTTCATCTTCCCGCCATCTGATGAGCAGTTGAAATCCGGAACTGCCTCTGTTGTGTGCCTGCTGAAT

AACTTCTATCCCAGAGAGGCCAAAGTACAGTGGAAGGTGGATAACGCCCTCCAATCGGGTAACTCCCA

GGAGAGTGTCACAGAGCAGGACAGCAAGGACAGCACCTACAGCCTCAGCAGCACCCTGACGCTGAGC

AAAGCAGACTACGAGAAACACAAAGTCTACGCCTGCGAAGTCACCCATCAGGGCCTGAGCTCGCCCG

TCACAAAGAGCTTCAACAGGGGAGAGTGC

1538 Heavy chain nt sequence (SEQ ID NO: 5779)

GAGGTGCAGCTGTTGGAGTCTGGGGGAGGCTTGGTACAGCCTGGGGGGTCCCTGAGACTCTCCTGTGC

AGCCTCTGGATTCACCTTTAGCAGCTATGCCATGAGCTGGGTCCGCCAGGCTCCAGGGAAGGGGCTGG

AGTGGGTCTCAGGTATTAGTGATAGTGGTGGTAGCACATACTACGCAGACTACGTGAAGGGCCGGTTC

ACCATCTCCAGAGACAATTCCAAGGACACGCTGTATCTGCAAATGAACAGCCTGAGAGCCGAGGACA

CGGCCGTATATTACTGTGCGAAAGATCGGGGAACGAGTACGCCCTGACCCACTACTACTACTACGCT

ATGGACGTCTGGGGCCAAGGGACCACGGTCACCGTCTCCTCAGCCTCCACCAAGGGCCCATCGGTCTT

CCCCCTGGCACCCTCCTCCAAGAGCACCTCTGGGGGCACAGCGGCCCTGGGCTGCCTGGTCAAGGACT

ACTTCCCCGAACCGGTGACGGTGTCGTGGAACTCAGGCGCACTGACCAGCGGCGTGCACACCTTCCCG

GCTGTCCTACAGTCCTCAGGACTCTACTCCCTCAGCAGCGTGGTGACCGTGCCCTCCAGCAGCTTGGGC

ACCCAGACCTACATCTGCAACGTGAATCACAAGCCCAGCAACACCAAGGTGGACAAGAGAGTTGAGC

CCAAATCTTGTGACAAAACTCACACATGCCCACCGTGCCCAGCACCTGAACTCCTGGGGGGACCGTCA

GTCTTCCTCTTCCCCCCAAAACCCAAGGACACCCTCATGATCTCCCGGACCCCTGAGGTCACATGCGTG

GTGGTGGACGTGAGCCACGAAGACCCTGAGGTCAAGTTCAACTGGTATGTGGACGGCGTGGAGGTGC

ATAATGCCAAGACAAAGCCGCGGGAGGAGCAGTACAACAGCACGTACCGTGTGGTCAGCGTCCTCAC

CGTCCTGCACCAAGACTGGCTGAATGGCAAGGAGTACAAGTGCAAGGTCTCCAACAAAGCCCTCCCA

GCCCCCATCGAGAAAACCATCTCCAAAGCCAAAGGGCAGCCCCGAGAACCACAGGTGTACACCCTGC

CCCCATCCCGGGAGGAGATGACCAAGAACCAAGTCAGCCTGACCTGCCTGGTCAAAGGCTTCTATCCC

AGCGACATCGCCGTGGAGTGGGAGAGCAATGGGCAGCCGGAGAACAACTACAAGACCACGCCTCCCG

TGCTGGACTCCGACGGCTCCTTCTTCCTCTATTCCAAGCTCACCGTGGACAAGAGCAGGTGGCAGCAG

GGGAACGTCTTCTCATGCTCCGTGATGCATGAGGCTCTGCACAACCACTACACGCAGAAGAGCCTCTC

CCTGTCTCCGGGCAAA

1538 Light chain nt sequence (SEQ ID NO: 5780)

GACATCCAGATGACCCAGTCTCCATCCTCCCTGTCTGCATCTGTAGGAGACAGAGTCACCATCACTTGC

CGGGCAAGTCAGAGCATTAGCAGCTATTTAAATTGGTATCAGCAGAAACCAGGGAAAGCCCCTAAGC

TCCTGATCTATGCTGCATACAGTTTGCAAAGTGGGGTCCCATCAAGGTTCAGTGGCGGTGGATCTGGG

ACAGATTTCACTCTCACCATCAGCAGTCTGCAACCTGAAGATTTTGCAACTTACTTCTGTCAACAGAGT

TACAGTACCCCGATCACTTTCGGCCAAGGGACACGACTGGAGATTAAAAGAACTGTGGCGGCGCCATC

TGTCTTCATCTTCCCGCCATCTGATGAGCAGTTGAAATCCGGAACTGCCTCTGTTGTGTGCCTGCTGAA

TAACTTCTATCCCAGAGAGGCCAAAGTACAGTGGAAGGTGGATAACGCCCTCCAATCGGGTAACTCCC

AGGAGAGTGTCACAGAGCAGGACAGCAAGGACAGCACCTACAGCCTCAGCAGCACCCTGACGCTGAG

CAAAGCAGACTACGAGAAACACAAAGTCTACGCCTGCGAAGTCACCCATCAGGGCCTGAGCTCGCCC

GTCACAAAGAGCTTCAACAGGGGAGAGTGC

1585 Heavy chain nt sequence
(SEQ ID NO: 5781)

CAGGTACAGCTGGTGGAGTCTGGGGGAGGCGTGGTCCAGCCTGGGAGGTCCCTGAGACTCTCCTGTGC

AGCCTCTGGATTCACCTTCAGTAGATTTACTCTACACTGGGTCCGCCAGGCTCCAGGCAAGGGGCTGG

AGTGGGTGGCAGTTATATCATATGATGGAAGCAATAAATATTACGCAGACTCCGTGAAGGGCCGATTC

ACCATCTCCAGAGACAATTCCAAGAGCACTCTCTATCTGCAAATGAACAGCCTGAGAGCTGAGGACAC

GGGTGTGTATTACTGTGCGAGAGATCCCTCTACGGTGACCGGCTACTTTGACTACTGGGGCCAGGGAA

CCCTGGTCACCGTCTCCTCAGCCTCCACCAAGGGCCCATCGGTCTTCCCCCTGGCACCCTCCTCCAAGA

GCACCTCTGGGGGCACAGCGGCCCTGGGCTGCCTGGTCAAGGACTACTTCCCCGAACCGGTGACGGTG

TCGTGGAACTCAGGCGCACTGACCAGCGGCGTGCACACCTTCCCGGCTGTCCTACAGTCCTCAGGACT

CTACTCCCTCAGCAGCGTGGTGACCGTGCCCTCCAGCAGCTTGGGCACCCAGACCTACATCTGCAACG

TGAATCACAAGCCCAGCAACACCAAGGTGGACAAGAGAGTTGAGCCCAAATCTTGTGACAAAACTCA

CACATGCCCACCGTGCCCAGCACCTGAACTCCTGGGGGGACCGTCAGTCTTCCTCTTCCCCCCAAAACC

CAAGGACACCCTCATGATCTCCCGGACCCCTGAGGTCACATGCGTGGTGGTGGACGTGAGCCACGAAG

ACCCTGAGGTCAAGTTCAACTGGTATGTGGACGGCGTGGAGGTGCATAATGCCAAGACAAAGCCGCG

GGAGGAGCAGTACAACAGCACGTACCGTGTGGTCAGCGTCCTCACCGTCCTGCACCAAGACTGGCTGA

ATGGCAAGGAGTACAAGTGCAAGGTCTCCAACAAAGCCCTCCCAGCCCCCATCGAGAAAACCATCTCC

AAAGCCAAAGGGCAGCCCCGAGAACCACAGGTGTACACCCTGCCCCCATCCCGGGAGGAGATGACCA

AGAACCAAGTCAGCCTGACCTGCCTGGTCAAAGGCTTCTATCCCAGCGACATCGCCGTGGAGTGGGAG

AGCAATGGGCAGCCGGAGAACAACTACAAGACCACGCCTCCCGTGCTGGACTCCGACGGCTCCTTCTT

CCTCTATTCCAAGCTCACCGTGGACAAGAGCAGGTGGCAGCAGGGGAACGTCTTCTCATGCTCCGTGA

TGCATGAGGCTCTGCACAACCACTACACGCAGAAGAGCCTCTCCCTGTCTCCGGGCAAA

1585 Light chain nt sequence
(SEQ ID NO: 5782)

TCCTATGTGCTGACTCAGCCACCCTCAGTGTCAGTGGCCCCAGGAAAGACGGCCAAGATTTCCTGTGG

GGGAGACAGCATTGGAAGTAAAAGTGTCCACTGGTACCAGCAGAAGCCAGGCCAGGCCCCTGTGCTG

GTCATCTATTATGATAACGACCGGCCCTCAGGGATCCCTGAGCGATTCTCTGGCTCCAACTCTGGGAAC

ACGGCCACCCTGACCATCAGCAGGGTCGAAGCCGGGGATGAGGCCGACTATTACTGTCAGGTGTGGG

ATATTGGTGTGGTATTCGGCGGAGGGACCAAGCTGACCGTCCTAGGCCAGCCCAAGGCTGCCCCCTCG

GTCACTCTGTTCCCGCCCTCCTCTGAGGAGCTTCAAGCCAACAAGGCCACACTGGTGTGTCTCATAAGT

GACTTCTACCCGGGAGCCGTGACAGTGGCCTGGAAGGCAGATAGCAGCCCCGTCAAGGCGGGAGTGG

AGACAACCACACCCTCCAAACAAAGCAACAACAAGTACGCGGCCAGCAGCTATCTGAGCCTGACGCC

TGAGCAGTGGAAGTCCCACAGAAGCTACAGCTGCCAGGTCACGCATGAAGGGAGCACCGTGGAGAAG

ACAGTGGCCCCTACAGAATGTTCA

DNA encoding the anti-coronavirus antibodies (e.g., anti-SARS-CoV-2 antibodies) disclosed herein may be readily isolated and sequenced using conventional procedures (e.g., by using oligonucleotide probes that are capable of binding specifically to genes encoding antibody heavy and light chains). Isolated and subcloned hybridoma cells (or phage or yeast derived colonies) may serve as a preferred source of such DNA. More particularly, the isolated DNA (which may be modified) can be used to clone constant and variable region sequences for the manufacture of antibodies.

One exemplary method entails extraction of RNA from the selected cells, conversion to cDNA, and amplification by PCR using antibody specific primers. Suitable primers are well known in the art, and as exemplified herein, are readily available from numerous commercial sources. It will be appreciated that, to express a recombinant human or non-human antibody isolated by screening of a combinatorial library, the DNA encoding the antibody is cloned into a recombinant expression vector and introduced into host cells including mammalian cells, insect cells, plant cells, yeast, and bacteria. In yet other embodiments, the modulators are introduced into and expressed by simian COS cells, NS0 cells, Chinese Hamster Ovary (CHO) cells or myeloma cells that do not otherwise produce the desired construct. As will be discussed in more detail below, transformed cells expressing the desired modulator may be grown up in relatively large quantities to provide clinical and commercial supplies of the fusion construct or immunoglobulin.

Whether the nucleic acid encoding an anti-coronavirus antibody (e.g., anti-SARS-CoV-2 antibody) disclosed herein is obtained or derived from phage display technology, yeast libraries, hybridoma based technology, synthetically, or from commercial sources, it should be understood that the inventions disclosed herein encompass nucleic acid molecules and sequences encoding anti-coronavirus antibodies (e.g., anti-SARS-CoV-2 antibodies), fusion proteins, or antigen-binding fragments or derivatives thereof. The inventions disclosed herein further encompass nucleic acids or nucleic acid molecules (e.g., polynucleotides) that hybridize under high stringency, or alternatively, under intermediate or lower stringency hybridization conditions (e.g., as defined below), to polynucleotides complementary to nucleic acids having a polynucleotide sequence that encodes a modulator of the invention or a fragment or variant thereof. The term nucleic acid molecule or isolated nucleic acid molecule, as used herein, is intended to include at least DNA molecules and RNA molecules. A nucleic acid molecule may be single-stranded or double-stranded, but preferably is double-stranded DNA. Moreover, the present invention comprises any vehicle or construct, incorporating such modulator encoding polynucleotide including, without limitation, vectors, plasmids, host cells, cosmids or viral constructs.

As used herein, the term "isolated nucleic acid" refers to a nucleic acid that was (i) amplified in vitro, for example by polymerase chain reaction (PCR), (ii) recombinantly produced by cloning, (iii) purified, for example by cleavage and gel-electrophoretic fractionation, or (iv) synthesized, for example by chemical synthesis. An isolated nucleic acid is a nucleic acid that is available for manipulation by recombinant DNA techniques.

More specifically, nucleic acids that encode anti-coronavirus antibodies (e.g., anti-SARS-CoV-2 antibodies) described herein, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing are also encompassed herein. Such nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. These nucleic acids can be single-stranded or double-stranded and can comprise RNA and/or DNA nucleotides, and artificial variants thereof (e.g., peptide nucleic acids).

As indicated, the invention further provides nucleic acids that hybridize to other nucleic acids under particular hybridization conditions. Methods for hybridizing nucleic acids are well known in the art. For example, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. One of skill in the art can manipulate the hybridization and/or washing conditions to increase or decrease the stringency of hybridization such that nucleic acids comprising nucleotide sequences that are at least 65, 70, 75, 80, 85, 90, 95, 98 or 99% identical to each other typically remain hybridized to each other. More generally, for the purposes of the instant disclosure the term "substantially identical" with regard to a nucleic acid sequence refers to a sequence of nucleotides exhibiting at least about 85%, or 90%, or 95%, or 97% sequence identity to the reference nucleic acid sequence. The basic parameters affecting the choice of hybridization conditions and guidance for devising suitable conditions are well known, and can be readily determined by those having ordinary skill in the art based on, for example, the length and/or base composition of the nucleic acid.

It will further be appreciated that nucleic acids may be present alone or in combination with other nucleic acids, which may be homologous or heterologous. In preferred embodiments, a nucleic acid is functionally linked to expression control sequences that may be homologous or heterologous with respect to that nucleic acid. In this context, the term "homologous" means that a nucleic acid is also functionally linked to the expression control sequence naturally and the term "heterologous" means that a nucleic acid is not functionally linked to the expression control sequence naturally.

A nucleic acid, such as a nucleic acid expressing RNA and/or protein or peptide, and an expression control sequence are functionally linked to one another, if they are covalently linked to one another in such a way that expression or transcription of the nucleic acid is under the control or under the influence of the expression control sequence. If the nucleic acid is to be translated into a functional protein, then, with an expression control sequence functionally linked to a coding sequence, induction of the expression control sequence results in transcription of the nucleic acid, without causing a frame shift in the coding sequence or the coding sequence not being capable of being translated into the desired protein or peptide. As used herein, the term "expression control sequence" includes promoters, ribosome binding sites, enhancers and other control elements that regulate transcription of a gene or translation of mRNA. In particular embodiments, the expression control sequences can be regulated. The exact structure of expression control sequences may vary as a function of the species or cell type, but generally comprises 5'-untranscribed and 5'- and 3'-untranslated sequences which are involved in initiation of transcription and translation, respectively, such as TATA box, capping sequence, CAAT sequence, and the like. More specifically, 5'-untranscribed expression control sequences comprise a promoter region that includes a promoter sequence for transcriptional control of the functionally linked nucleic acid. Expression control sequences may also comprise enhancer sequences or upstream activator sequences.

As used herein, the term "promoter" or "promoter region" relates to a nucleic acid sequence which is located upstream (5') to the nucleic acid sequence being expressed and controls expression of the sequence by providing a recognition and binding site for RNA-polymerase. The promoter region may include further recognition and binding sites for further factors that are involved in the regulation of transcription of a gene. A promoter may control the transcription of a prokaryotic or eukaryotic gene. Furthermore, a promoter may be inducible and may initiate transcription in response to an inducing agent or may be constitutive if transcription is not controlled by an inducing agent. A gene that is under the control of an inducible promoter is not expressed or only expressed to a small extent if an inducing agent is absent. In the presence of the inducing agent the gene is switched on or the level of transcription is increased. This is mediated, in general, by binding of a specific transcription factor.

Promoters for use in the production of anti-coronavirus antibodies (e.g., anti-SARS-CoV-2 antibodies) disclosed herein include promoters for SP6, T3 and T7 polymerase, human U6 RNA promoter, CMV promoter, and artificial hybrid promoters thereof (e.g., CMV) where a part or parts are fused to a part or parts of promoters of genes of other cellular proteins such as e.g. human GAPDH (glyceraldehyde-3-phosphate dehydrogenase), and may include (an) additional intron(s).

As used herein, the term "expression" is used in its most general meaning and comprises the production of RNA or of RNA and protein/peptide. It also comprises partial expression of nucleic acids. Furthermore, expression may be carried out transiently or stably.

In a preferred embodiment, a nucleic acid molecule present in a vector, where appropriate with a promoter, which controls expression of the nucleic acid. As used herein, the term "vector" is used here in its most general meaning and comprises any intermediary vehicle for a nucleic acid that enables the nucleic acid, for example, to be introduced into prokaryotic and/or eukaryotic cells and, where appropriate, to be integrated into a genome. Vectors of this kind are preferably replicated and/or expressed in the cells. Vectors may comprise plasmids, phagemids, bacteriophages or viral genomes. As used herein, the term "plasmid" generally relates to a construct of extrachromosomal genetic material, usually a circular DNA duplex, which can replicate independently of chromosomal DNA. In a preferred embodiment, the expression vector is a glutamine synthetase (GS) expression vector.

It will be appreciated by those of skill in the art, that many conventional techniques in molecular biology, microbiology, and recombinant DNA technology are optionally used. Such conventional techniques relate to vectors, host cells and recombinant methods as defined herein. In addition, essentially any polynucleotide (including, e.g., labeled or biotinylated polynucleotides) can be obtained from any of a variety of commercial sources.

The inventions disclosed herein also encompass recombinant host cells allowing recombinant expression of antibodies of the invention or portions thereof. Anti-coronavirus antibodies (e.g., anti-SARS-CoV-2 antibodies) disclosed herein produced by expression in such recombinant host cells are referred to herein as recombinant antibodies. The inventions disclosed herein also encompass progeny cells of such host cells, and anti-coronavirus antibodies (e.g., anti-SARS-CoV-2 antibodies) produced by the same. In a preferred embodiment, the host cell is a Chinese Hamster Ovary (CHO) cell.

As used herein, the term "recombinant host cell" or "host cell" means a cell into which a recombinant expression vector has been introduced. It should be understood that recombinant host cell and host cell mean not only the particular subject cell but also the progeny of such a cell. Because certain modifications may occur in succeeding generations due to either mutation or environmental influences, such progeny may not, in fact, be identical to the parent cell, but are still included within the scope of the term host cell as used herein. Such cells may comprise a vector as described above.

The inventions disclosed herein also encompass methods for making anti-coronavirus antibodies (e.g., anti-SARS-CoV-2 antibodies) disclosed herein. According to one embodiment, such a method comprises culturing a cell transfected or transformed with a vector as described above, and isolating the antibody.

As indicated above, expression of an antibody preferably comprises expression vector(s) containing a polynucleotide that encodes the anti-coronavirus antibody. Methods that are well known to those skilled in the art can be used to construct expression vectors comprising antibody coding sequences and appropriate transcriptional and translational control signals. These methods include, for example, in vitro recombinant DNA techniques, synthetic techniques, and in vivo genetic recombination. Particular embodiments provide replicable vectors comprising a nucleotide sequence encoding an anti-coronavirus antibody disclosed herein operably linked to a promoter. In preferred embodiments, such vectors may include a nucleotide sequence encoding the heavy chain of an antibody molecule (or fragment thereof), a nucleotide sequence encoding the light chain of an antibody (or fragment thereof), or both the heavy and light chain.

Using art recognized molecular biology techniques and current protein expression methodology, substantial quantities of the anti-coronavirus antibodies (e.g., anti-SARS-CoV-2 antibodies) disclosed herein may be produced. More specifically, nucleic acid molecules encoding such antibodies may be integrated into well-known and commercially available protein production systems comprising various types of host cells to provide preclinical, clinical, or commercial quantities of the desired pharmaceutical product. In preferred embodiments the nucleic acid molecules encoding the antibodies are engineered into vectors or expression vectors that provide for efficient integration into the selected host cell and subsequent high expression levels of the antibody.

Preferably nucleic acid molecules encoding anti-coronavirus antibodies (e.g., anti-SARS-CoV-2 antibodies) disclosed herein and vectors comprising these nucleic acid molecules can be used for transfection of a suitable mammalian, plant, bacterial or yeast host cell though it will be appreciated that prokaryotic systems may also be used. Transfection can be by any known method for introducing polynucleotides into a host cell. Methods for the introduction of heterologous polynucleotides into mammalian cells are well known in the art and include dextran-mediated transfection, calcium phosphate precipitation, polybrene-mediated transfection, protoplast fusion, electroporation, encapsulation of the polynucleotide(s) in liposomes, and direct microinjection of the DNA into nuclei. In addition, nucleic acid molecules may be introduced into mammalian cells by viral vectors. Methods of transforming mammalian cells are well known in the art. Methods of transforming plant cells are also well known in the art, including, e.g., *agrobacterium*-mediated transformation, biolistic transformation, direct injection, electroporation, and viral transformation. Methods of transforming bacterial and yeast cells are also well known in the art.

Moreover, the host cell may be co-transfected with two expression vectors of the invention, for example, the first vector encoding a heavy chain polypeptide and the second vector encoding a light chain polypeptide. The two vectors may contain identical selectable markers that enable substantially equal expression of heavy and light chain polypeptides. Alternatively, a single vector may be used which encodes, and is capable of expressing, both heavy and light chain polypeptides. In such situations, the light chain is preferably placed before the heavy chain to avoid an excess of toxic free heavy chain. The coding sequences for the heavy and light chains may comprise cDNA or genomic DNA.

Varieties of host-expression vector systems, many commercially available, may be used to express anti-coronavirus antibodies (e.g., anti-SARS-CoV-2 antibodies) disclosed herein. Such host-expression systems represent vehicles by which the coding sequences of interest may be expressed and subsequently purified, but also represent cells which may, when transformed or transfected with the appropriate nucleotide coding sequences, express a molecule of the invention in situ. Such systems include, but are not limited to, microorganisms such as bacteria (e.g., *E. coli, B. subtilis, streptomyces*) transformed with recombinant bacteriophage DNA, plasmid DNA or cosmid DNA expression vectors containing modulator coding sequences; yeast (e.g., *Saccharomyces, Pichia*) transfected with recombinant yeast expression vectors containing modulator coding sequences; insect cell systems infected with recombinant virus expression vectors (e.g., baculovirus) containing modulator coding sequences; plant cell systems (e.g., *Nicotiana, Arabidopsis*, duckweed, corn, wheat, potato, etc.) infected with recombinant virus expression vectors (e.g., cauliflower mosaic virus, CaMV; tobacco mosaic virus, TMV) or transfected with recombinant plasmid expression vectors (e.g., Ti plasmid) containing modulator coding sequences; or mammalian cell systems (e.g., COS, CHO, BHK, 293, 3T3 cells) harboring recombinant expression constructs containing promoters derived from the genome of mammalian cells (e.g., metallothionein promoter) or from mammalian viruses (e.g., the adenovirus late promoter; the vaccinia virus 7.5K promoter).

In bacterial systems, a number of expression vectors may be advantageously selected depending upon the use intended for the molecule being expressed. For example, when a large quantity of such a protein is to be produced, for the generation of pharmaceutical compositions, vectors which direct the expression of high levels of fusion protein products that are readily purified may be desirable.

In an insect system, *Autographa californica* nuclear polyhedrosis virus (AcNPV) may be used as a vector to express foreign genes. The virus grows in *Spodoptera frugiperda* cells. The coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be used to introduce the desired nucleotide sequence. In cases where an adenovirus is used as an expression vector, the coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the molecule in infected hosts. Specific initiation signals may also be required for efficient translation of inserted coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, and the like. Thus, compatible mammalian cell lines available as hosts for expression are well known in the art and include many immortalized cell lines available from the American Type Culture Collection (ATCC). These include, inter alia, Chinese hamster ovary (CHO) cells, NS0 cells, SP2 cells, HEK-293T cells, 293 Freestyle cells (Life Technologies), NIH-3T3 cells, HeLa cells, baby hamster kidney (BHK) cells, African green monkey kidney cells (COS), human hepatocellular carcinoma cells (e.g., Hep G2), A549 cells, and a number of other cell lines.

For long-term, high-yield production of recombinant proteins stable expression is preferred. Accordingly, cell lines that stably express the selected modulator may be engineered using standard art recognized techniques. Rather than using expression vectors that contain viral origins of replication, host cells can be transformed with DNA controlled by appropriate expression control elements (e.g., promoter, enhancer, sequences, transcription terminators, polyadenylation sites, etc.), and a selectable marker. Following the introduction of the foreign DNA, engineered cells may be allowed to grow for 1 to 2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the molecule. Such engineered cell lines may be particularly useful in screening and evaluation of compositions that interact directly or indirectly with the molecule.

A number of selection systems are well known in the art and may be used including, but not limited to, the herpes simplex virus thymidine kinase, hypoxanthineguanine phosphoribosyltransferase, and adenine phosphoribosyltransferase genes can be employed in tk−, hgprt− or aprt− cells, respectively. Also, antimetabolite resistance can be used as the basis of selection for the following genes: dhfr, which confers resistance to methotrexate; gpt, which confers resistance to mycophenolic acid; neo, which confers resistance to the aminoglycoside G-418; and hygro, which confers resistance to hygromycin.

Methods commonly known in the art of recombinant DNA technology may be routinely applied to select the desired recombinant clone. It will be appreciated by those of skill in the art that one particularly preferred method of establishing a stable, high yield cell line comprises the glutamine synthetase gene expression system (the GS system) which provides an efficient approach for enhancing expression under certain conditions.

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function and/or purification of the protein. Different host cells have characteristic and specific mechanisms for the post-translational processing and modification of proteins and gene products. As known in the art, appropriate cell lines or host systems can be chosen to ensure the desired modification and processing of the expressed polypeptide. To this end, eukaryotic host cells that possess the cellular machinery for proper processing of the primary transcript, glycosylation, and phosphorylation of the gene product are particularly effective. Accordingly, some preferred mammalian host lines include, but are not limited to, CHO, VERY, BHK, HeLa, COS, NS0, MDCK, 293, 3T3, and W138. Depending on the anti-coronavirus antibody (e.g., anti-SARS-CoV-2 antibody) and the selected production system, those of skill in the art may easily select and optimize appropriate host cells for efficient expression of the antibody.

Those of skill in the art will appreciate that anti-coronavirus antibodies (e.g., anti-SARS-CoV-2 antibodies) disclosed herein may be chemically synthesized using techniques known in the art. For example, a peptide corresponding to a polypeptide fragment of the invention can be synthesized by use of a peptide synthesizer. If desired, non-genetically encoded amino acids or synthetic amino acids can be substituted or added into a polypeptide sequence.

Representative non-genetically encoded amino acids include but are not limited to 2-aminoadipic acid; 3-aminoadipic acid; β-aminopropionic acid; 2-aminobutyric acid; 4-aminobutyric acid (piperidinic acid); 6-aminocaproic acid; 2-aminoheptanoic acid; 2-aminoisobutyric acid; 3-aminoisobutyric acid; 2-aminopimelic acid; 2,4-diaminobutyric acid; desmosine; 2,2'-diaminopimelic acid; 2,3-diaminopropionic acid; N-ethylglycine; N-ethylasparagine; hydroxylysine; allo-hydroxylysine; 3-hydroxyproline; 4-hydroxyproline; isodesmosine; allo-isoleucine; N-methylglycine (sarcosine); N-methylisoleucine; N-methylvaline; norvaline; norleucine; and ornithine.

Representative synthetic amino acids include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine.

Anti-coronavirus antibodies (e.g., anti-SARS-CoV-2 antibodies) disclosed herein also can be produced transgenically through the generation of a mammal or plant that is transgenic for the immunoglobulin heavy and light chain sequences (or fragments or derivatives or variants thereof) of interest and production of the desired compounds in a recoverable form. For example, anti-coronavirus antibodies (e.g., anti-SARS-CoV-2 antibodies), can be produced in, and recovered from, e.g., the milk of goats, cows, or other mammals. In some embodiments, non-human transgenic animals that comprise human immunoglobulin loci are immunized with SARS-CoV-2 virions or an immunogenic portion thereof, as described above.

Non-human transgenic animals or plants may be produced by introducing one or more nucleic acid molecules encoding an anti-coronavirus antibody into the animal or plant by standard transgenic techniques. The transgenic cells used for making the transgenic animal can be embryonic stem cells or somatic cells or a fertilized egg. The transgenic non-human organisms can be chimeric, nonchimeric heterozygotes, and nonchimeric homozygotes. In some embodiments, the transgenic non-human animals have a targeted disruption and replacement by a targeting construct that encodes, for example, a heavy chain and/or a light chain of interest. While anti-coronavirus antibodies (e.g., anti-SARS-CoV-2 antibodies) disclosed herein may be produced in any transgenic animal, particularly preferred embodiments include mice, rats, sheep, pigs, goats, cattle, and horses. In particular embodiments, the non-human transgenic animal expresses the desired pharmaceutical product in blood, milk, urine, saliva, tears, mucus, and other bodily fluids from which it is readily obtainable using art recognized purification techniques.

It is likely that modulators, including antibodies, expressed by different cell lines or in transgenic animals will have different glycosylation patterns from each other. However, the instant inventions encompass anti-coronavirus antibodies (e.g., anti-SARS-CoV-2 antibodies) encoded by the nucleic acid molecules provided herein, or comprising the amino acid sequences provided herein, regardless of the glycosylation state of the molecule, and more generally, regardless of the presence or absence of post-translational modification(s). The instant inventions also encompass anti-coronavirus antibodies (e.g., anti-SARS-CoV-2 antibodies) that are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, acetylation, formylation, oxidation, reduction, metabolic synthesis in the presence of tunicamycin, etc. Various post-translational modifications are also encompassed by the invention include, for example, e.g., N-linked or O-linked carbohydrate chains, processing of N-terminal or C-terminal ends), attachment of chemical moieties to the amino acid backbone, chemical modifications of N-linked or O-linked carbohydrate chains, and addition or deletion of an N-terminal methionine residue as a result of prokaryotic host cell expression. Moreover, as set forth in the text and below the anti-coronavirus antibodies (e.g., anti-SARS-CoV-2 antibodies) disclosed herein may also be modified with a detectable label, such as an enzymatic, fluorescent, radioisotopic or affinity label to allow for their detection and isolation.

Once anti-coronavirus antibodies (e.g., anti-SARS-CoV-2 antibodies) disclosed herein have been produced by recombinant expression or any one of the other techniques disclosed herein, they may be purified by any method known in the art for purification of immunoglobulins, or more generally by any other standard technique for the purification of proteins. In this respect the anti-coronavirus antibody (e.g., anti-SARS-CoV-2 antibody) may be isolated. As used herein, an "isolated anti-coronavirus antibody" is one that has been identified and separated and/or recovered from a component of its natural environment. Contaminant components of its natural environment are materials that would interfere with diagnostic or therapeutic uses of the antibody and may include enzymes, hormones, and other proteinaceous or non-proteinaceous solutes. Isolated anti-coronavirus antibodies (e.g., anti-SARS-CoV-2 antibodies) include antibodies in situ within recombinant cells because at least one component of the antibody's natural environment will not be present.

When using recombinant techniques, anti-coronavirus antibodies (e.g., anti-SARS-CoV-2 antibodies) disclosed herein can be produced intracellularly, in the periplasmic space, or directly secreted into the medium. If the desired molecule is produced intracellularly, as a first step, the particulate debris, either host cells or lysed fragments, may be removed, for example, by centrifugation or ultrafiltration. Where the antibody is secreted into the medium, supernatants from such expression systems are generally first concentrated using a commercially available protein concentration filter. A protease inhibitor such as PMSF may be included in any of the foregoing steps to inhibit proteolysis and antibiotics may be included to prevent the growth of adventitious contaminants.

Compositions comprising anti-coronavirus antibodies (e.g., anti-SARS-CoV-2 antibodies) disclosed herein prepared from cells can be purified using, for example, hydroxyapatite chromatography, gel electrophoresis, dialysis, and affinity chromatography. The suitability of protein A as an affinity ligand depends on the species and isotype of any immunoglobulin Fc region that is present in the selected construct. Protein A can be used to purify antibodies that are based on human IgG1, IgG2 or IgG4 heavy chains. Protein G is recommended for all mouse isotypes and for human IgG3. The matrix to which the affinity ligand is attached is most often agarose, but other matrices are available. Mechanically-stable matrices such as controlled pore glass or poly(styrenedivinyl)benzene allow for faster flow rates and shorter processing times than can be achieved with agarose. Where the antibody comprises a $C_H3$ region, the BAKERBOND ABX™ resin is useful for purification. Other techniques for protein purification such as fractionation on an ion-exchange column, ethanol precipitation, reverse phase HPLC, chromatography on silica, chromatography on heparin, SEPHAROSE® chromatography on an anion or cation exchange resin (such as a polyaspartic acid column), chromatofocusing, SDS-PAGE and ammonium sulfate precipitation are also available depending on the antibody to be recovered. In some embodiments, anti-coronavirus antibodies (e.g., anti-SARS-CoV-2 antibodies) disclosed herein are purified, at least in part, using Protein A or Protein G affinity chromatography.

By way of illustration of the foregoing, cDNA sequences encoding an anti-coronavirus antibody (e.g., anti-SARS-CoV-2 antibody) heavy chain and light chain may be cloned and engineered into a glutamine synthetase (GS) expression vector. The engineered immunoglobulin expression vector may then be stably transfected into CHO cells. As one skilled in the art will appreciate, mammalian expression of antibodies will result in glycosylation, typically at highly conserved N-glycosylation sites in the Fc region. Stable clones may be verified for expression of an antibody specifically binding to SARS-CoV Spike protein or SARS-CoV-2 Spike protein. Positive clones may be expanded into serum-free culture medium for antibody production in bioreactors. Medium, into which an antibody has been secreted, may be purified by conventional techniques. For example, the medium may be conveniently applied to a Protein A or G SEPHAROSE® FF column that has been equilibrated with a compatible buffer, such as phosphate buffered saline. The column is washed to remove nonspecific binding components. The bound antibody is eluted, for example, by pH gradient and antibody fractions are detected, such as by SDS-PAGE, and then pooled. The antibody may be concentrated and/or sterile filtered using common techniques. Soluble aggregate and multimers may be effectively removed by common techniques, including size exclusion, hydrophobic interaction, ion exchange, or hydroxyapatite chromatography. The product may be immediately frozen, for example, at −70° C., or may be lyophilized.

Anti-Coronavirus Antibody Conjugates

Once anti-coronavirus antibodies (e.g., anti-SARS-CoV-2 antibodies) disclosed herein have been purified, they may be linked with, fused to, conjugated to (e.g., covalently or non-covalently) or otherwise associated with diagnostic moieties or biocompatible modifiers. As used herein the term "conjugate" means any molecule associated with an anti-coronavirus antibody (e.g., anti-SARS-CoV-2 antibody) disclosed herein regardless of the method of association. In this respect it will be understood that such conjugates may comprise peptides, polypeptides, proteins, polymers, nucleic acid molecules, small molecules, mimetic agents, synthetic drugs, inorganic molecules, organic molecules and radioisotopes. Moreover, as indicated above the selected conjugate may be covalently or non-covalently linked to the antibody and exhibit various molar ratios depending, at least in part, on the method used to effect the conjugation.

In some embodiments, anti-coronavirus antibodies (e.g., anti-SARS-CoV-2 antibodies) disclosed herein may be conjugated or associated with proteins, polypeptides or peptides that impart selected characteristics (e.g., biotoxins, biomarkers, purification tags, etc.). In particular embodiments, anti-coronavirus antibodies (e.g., anti-SARS-CoV-2 antibodies) disclosed herein are recombinantly fused or chemically conjugated (including both covalent and non-covalent conjugations) to a heterologous protein or polypeptide wherein the polypeptide comprises at least 10, at least 20, at least 30, at least 40, at least 50, at least 60, at least 70, at least 80, at least 90 or at least 100 amino acids. The construct does not necessarily need to be directly linked, but may occur through linker sequences. For example, anti-coronavirus antibodies (e.g., anti-SARS-CoV-2 antibodies) may be used to target heterologous polypeptides to virions or infected cells, either in vitro or in vivo, by fusing or conjugating the antibodies to other antibodies specific for other antigens. Moreover, anti-coronavirus antibodies (e.g., anti-SARS-CoV-2 antibodies) that are fused or conjugated to heterologous polypeptides may also be used in in vitro immunoassays and may be compatible with purification methodology known in the art.

In some embodiments, anti-coronavirus antibodies (e.g., anti-SARS-CoV-2 antibodies) disclosed herein may be conjugated or otherwise associated with biocompatible modifiers that may be used to adjust, alter, improve, or moderate antibody properties. For example, antibodies or fusion constructs with increased in vivo half-lives can be generated by attaching relatively high molecular weight polymer molecules such as commercially available polyethylene glycol (PEG) or similar biocompatible polymers. Those skilled in the art will appreciate that PEG may be obtained in many different molecular weight and molecular configurations that can be selected to impart specific properties to the antibody (e.g., the half-life may be tailored). PEG can be attached to modulators or antibody fragments or derivatives with or without a multifunctional linker either through site-specific conjugation of the PEG to the N- or C-terminus of antibodies or via epsilon-amino groups present on lysine residues. Linear or branched polymer derivatization that results in minimal loss of biological activity may be used. The degree of conjugation can be closely monitored by SDS-PAGE and mass spectrometry to ensure optimal conjugation of PEG molecules to antibody molecules. Unreacted PEG can be separated from antibody-PEG conjugates by, e.g., size exclusion or ion-exchange chromatography. In a similar manner, the disclosed modulators can be conjugated to albumin in order to make the antibody or antibody fragment more stable in vivo or have a longer half-life in vivo. The techniques are well known in the art. Other biocompatible conjugates are evident to those of ordinary skill and may readily be identified and utilized in accordance with the teachings herein.

In other embodiments, anti-coronavirus antibodies (e.g., anti-SARS-CoV-2 antibodies) disclosed herein are conjugated to a diagnostic or detectable agent, marker or reporter which may be a biological molecule (e.g., a peptide or nucleotide), a small molecule, fluorophore, or radioisotope. Labeled modulators can be useful for monitoring the development of SARS-CoV-2 infection or as part of a clinical testing procedure to determine the efficacy of a particular therapy including anti-coronavirus antibodies (e.g., anti-SARS-CoV-2 antibodies) disclosed herein (i.e., theragnostics), or to determine a future course of treatment. Such markers or reporters may also be useful in purifying anti-coronavirus antibodies (e.g., anti-SARS-CoV-2 antibodies) disclosed herein.

Diagnosis and detection can be accomplished by coupling the modulator to detectable substances including, but not limited to, various enzymes comprising for example horseradish peroxidase, alkaline phosphatase, beta-galactosidase, or acetylcholinesterase; prosthetic groups, such as but not limited to streptavidin/biotin and avidin/biotin; fluorescent materials, such as but not limited to, umbelliferone, fluorescein, fluorescein isothiocynate, rhodamine, dichlorotriazinylamine fluorescein, dansyl chloride or phycoerythrin; luminescent materials, such as but not limited to, luminol; bioluminescent materials, such as but not limited to, luciferase, luciferin, and aequorin; radioactive materials, such as but not limited to iodine ($^{131}I$, $^{125}I$, $^{123}I$, $^{121}I$,), carbon ($^{14}C$), sulfur ($^{35}S$), tritium ($^{3}H$), indium ($^{115}In$, $^{113}In$, $^{112}In$, $^{111}In$,) and technetium ($^{99}Tc$), thallium ($^{201}Ti$), gallium ($^{68}Ga$, $^{67}Ga$), palladium ($^{103}Pd$), molybdenum ($^{99}Mo$), xenon ($^{133}Xe$), fluorine ($^{18}F$), $^{153}Sm$, $^{177}Lu$, $^{59}Gd$, $^{140}La$, $^{175}Yb$, $^{166}Ho$, $^{90}Y$, $^{47}Sc$, $^{186}Re$, $^{188}Re$, $^{142}Pr$, $^{105}Rh$, $^{97}Ru$, $^{68}Ge$, $^{57}Co$, $^{65}Zn$, $^{85}Sr$, $^{32}P$, $^{153}Gd$, $^{169}Yb$, $^{51}Cr$, $^{54}Mn$, $^{75}Se$, $^{113}Sn$, and $^{117}Tin$; positron emitting metals using various positron emission tomographies, non-radioactive paramagnetic metal ions, and molecules that are radiolabeled or conjugated to specific radioisotopes. In such embodiments appropriate detection methodology is well known in the art and readily available from numerous commercial sources.

In other embodiments, anti-coronavirus antibodies (e.g., anti-SARS-CoV-2 antibodies) disclosed herein can be fused to marker sequences, such as a peptide or fluorophore to facilitate purification or diagnostic procedures such as immunohistochemistry or FACs. In some embodiments, the marker amino acid sequence is a hexa-histidine peptide, such as the tag provided in a pQE vector, among others, many of which are commercially available. Other peptide tags useful for purification include, but are not limited to, the hemagglutinin "HA" tag, which corresponds to an epitope derived from the influenza hemagglutinin protein and the "flag" tag.

In yet other embodiments, anti-coronavirus antibodies (e.g., anti-SARS-CoV-2 antibodies) disclosed herein can be conjugated to an immunomodulator, cytokine, cytotoxic agent, chemotherapeutic agent, antiviral agent, antimicrobial agent, or other drug. In some embodiments, the antibodies are conjugated to an antiviral agent.

Diagnostic Methods Using Anti-Coronavirus Antibodies

The inventions disclosed herein also encompass in vitro or in vivo methods for detecting, diagnosing or monitoring coronavirus infections and methods of screening cells from a patient to identify coronavirus infected cells, including cells from a patient who is currently infected with SARS-CoV-2, or cells from a patient who is recovered from a past SARS-CoV-2 infection. Such methods include identifying an individual infected with coronavirus for treatment, monitoring progression of a coronavirus infection comprising contacting the patient or a sample obtained from a patient with one or more anti-coronavirus antibodies (e.g., anti-SARS-CoV-2 antibodies) disclosed herein, and detecting the presence or absence, or level of association of the antibody to a coronavirus antigen in the sample. In a particularly preferred embodiment, one or more anti-coronavirus antibodies (e.g., anti-SARS-CoV-2 antibodies) disclosed herein may be used to detect and quantify coronavirus levels in a patient sample (e.g., plasma or blood). Association with a coronavirus antigen in the sample likely denotes that the individual may be effectively treated with one or more anti-coronavirus antibodies (e.g., anti-SARS-CoV-2 antibodies) disclosed herein. The methods may further comprise a step of comparing the level of binding to a control. Other diagnostic or theragnostic methods compatible with the teachings herein are well known in the art and can be practiced using commercial materials such as dedicated reporting systems.

Exemplary compatible assay methods include radioimmunoassays, enzyme immunoassays, competitive-binding assays, fluorescent immunoassay, immunoblot assays, Western Blot analysis, flow cytometry assays, and ELISA assays. More generally detection of coronavirus in a biological sample may be accomplished using any art-known assay. Compatible in vivo theragnostics or diagnostics may comprise art recognized imaging or monitoring techniques such as magnetic resonance imaging (MRI), computerized tomography (e.g., CAT scan), positron tomography (e.g., PET scan) radiography, ultrasound, etc. Those skilled in the art will readily be able to recognize and implement appropriate detection, monitoring or imaging techniques (often comprising commercially available sources) based on the etiology, pathological manifestation, or clinical progression of the disorder.

In another embodiment, the invention provides a method of analyzing coronavirus infection progression and/or pathogenesis in vivo.

In another aspect, and as discussed in more detail below, the inventions disclosed herein also encompass kits for detecting, monitoring, or diagnosing a coronavirus infection, identifying an individual having a coronavirus infection for possible treatment or monitoring progression (or regression) of the infection in a patient, wherein the kit comprises an anti-coronavirus antibody as described herein, and reagents for detecting the effect of the anti-coronavirus antibody (e.g., anti-SARS-CoV-2 antibody) on a sample from the patient.

Anti-coronavirus antibodies (e.g., anti-SARS-CoV-2 antibodies) disclosed herein and cells, cultures, populations and compositions comprising the same, including progeny thereof, can also be used to screen for or identify compounds or agents (e.g., drugs) that affect a function or activity of coronavirus virions or coronavirus infected cells or progeny thereof by binding to an antigen present on the surface of the virion or infected cell. The inventions disclosed herein therefore encompass systems and methods for evaluation or identification of a compound or agent that can affect a function or activity of the coronavirus virus. Such compounds and agents can be drug candidates that are screened for the treatment of coronavirus infection, for example. In one embodiment, a system or method comprises coronavirus virions and/or coronavirus infected cells and a compound or agent (e.g., drug), wherein the virions/cells and compound or agent (e.g., drug) are in contact with each other.

Anti-coronavirus antibodies (e.g., anti-SARS-CoV-2 antibodies) disclosed herein may also be used as a reagent to test a vaccine, such as an inactivated virus, live-attenuated vaccine, or recombinant subunit vaccine. In some embodiments, such anti-SARS-CoV-2 antibodies or antigen binding fragments comprise: (i) three CDRs in the heavy chain variable region (VH) set forth as SEQ ID NO: 661 and three CDRs in the light chain variable region (VL) set forth as SEQ ID NO: 662; (ii) three CDRs in the VH set forth as SEQ ID NO: 727 and three CDRs in the VL set forth as SEQ ID NO: 728; (iii) three CDRs in the VH set forth as SEQ ID NO: 761 and three CDRs in the VL set forth as SEQ ID NO: 762; (iv) three CDRs in the VH set forth as SEQ ID NO: 867 and three CDRs in the VL set forth as SEQ ID NO: 868; (v) three CDRs in the VH set forth as SEQ ID NO: 1123 and three CDRs in the VL set forth as SEQ ID NO: 1124; (vi) three CDRs in the VH set forth as SEQ ID NO: 1167 and three CDRs in the VL set forth as SEQ ID NO: 1168; (vii) three CDRs in the VH set forth as SEQ ID NO: 1267 and three CDRs in the VL set forth as SEQ ID NO: 1268; or (viii) three CDRs in the VH set forth as SEQ ID NO: 1313 and three CDRs in the VL set forth as SEQ ID NO: 1314; wherein the CDRs are defined by Kabat, Chothia, MacCallum or North numbering. In other embodiments, such anti-SARS-CoV-2 antibodies or antigen binding fragments comprise (i) a heavy chain variable region (VH) set forth as SEQ ID NO: 661 and a light chain variable region (VL) set forth as SEQ ID NO: 662; (ii) a VH set forth as SEQ ID NO: 727 and a VL set forth as SEQ ID NO: 728; (iii) a VH set forth as SEQ ID NO: 761 and a VL set forth as SEQ ID NO: 762; (iv) a VH set forth as SEQ ID NO: 867 and a VL set forth as SEQ ID NO: 868; (v) a VH set forth as SEQ ID NO: 1123 and a VL set forth as SEQ ID NO: 1124; (vi) a VH set forth as SEQ ID NO: 1167 and a VL set forth as SEQ ID NO: 1168; (vii) a VH set forth as SEQ ID NO: 1267 and a VL set forth as SEQ ID NO: 1268; or (viii) a VH set forth as SEQ ID NO: 1313 and a VL set forth as SEQ ID NO: 1314. Anti-SARS-CoV-2 antibodies comprising the six CDRs, or heavy and light chain variable regions, of mAbs 851, 894, 896, 923, 936, 970, 1015, 1036, 1037, 1075, 1130, 1135, 1139, 1149, 1404, 1444, 1495, 1538, and 1585 are also particularly contemplated.

The amino acid sequences of some of the antibodies described in the preceding paragraph have been previously described. The others are provided below.

258-VH
(SEQ ID NO: 661)
QVQLQESGPGLVKPSETLSLTCTVSGGSISSYYWSWIRQPAGKGLEWIG
RIYTSGSTNYNPSLKSRVTMSVDTSKNQFSLKLSSVTAADTAVYYCAAG
YGSIDYWGQGTLVTVSS

258-VL
(SEQ ID NO: 662)
DIVMTQSPLSLPVTPGEPASISCRSSQSLLHSNGYNYLDWYLQKPGQSP
QLLIYLGSNRASGVPDRFSGSGSGTDFTLKISRVEAEDVGVYYCMQALQ
TPRTFGQGTKLEIK

291-VH
(SEQ ID NO: 727)
QVQLVESGGGVVQPGRSLRLSCAASGFTFSSYAMHWVRQAPGKGLEWVA
VISYDGSNKYYADSVKGRFTISRDNSKNTLYLQMNSLRAEDTAVYYCAR
ASGGSYFGGMDVWGQGTTVTVSS

291-VL
(SEQ ID NO: 728)
QSALTQPASVSGSPGQSITISCTGTSSDVGGYNYVSWYQQHPGKAPKLM
IYEVSNRPSGVSNRFSGSKSGNTASLTISGLQAEDEADYYCSSYTSSST
LYVFGTGTKVTVL

308-VH
(SEQ ID NO: 761)
QLQLQESGPGLVKPSETLSLTCSVSGGSISSSSYHWGWIRQPPGKGLEW
IGSIYYSGSTYYNPSLKSRVTISVDTSKNQFSLKLRSVTAADTAVYYCA
GLRVVITFGGVIPKGGAFDIWGQGTMVTVSS

308-VL
(SEQ ID NO: 762)
QSALTQPASVSGSPGQSITISCTGTSSDVGGYNYVSWYQQHPGKAPKLM
IYDVSNRPSGVSNRFSGSKSGNTASLTISGLQAEDEADYYCSSYTSSST
VVFGGGTKLTVL

361-VH
(SEQ ID NO: 867)
QVQLQESGPGLVKPSQTLSLTCTVSGGSISSGGYYWSWIRQHPGKGLEW
IGYIYYSGSTYYNPSLKSRVTISVDTSKNQFSLKLSSVTAADTAVYYCA
TTMVRGVIRLDHYGMDVWGQGTTVTVSS

361-VL
(SEQ ID NO: 868)
QSALTQPASVSGSPGQSITISCTGTSSDVGGYNYVSWYQQHPGKAPKLM
IYEVSNRPSGVSNRFSGSKSGNTASLTISGLQAEDEADYYCSSYTSSST
LLFGTGTKVTVL

DIQMTQSPSSLSASVGDRVTITCQASQDISNYLNWYQQKPGKAPKLLIY
DASNLETGVPSRFSGSGSGTDFTFTISSLQPEDIATYYCQQYDNLPITF
GQGTRLEIK

489-VH
(SEQ ID NO: 1123)
QVQLVESGGGVVQPGRSLRLSCAASGFTFSSYAMHWVRQAPGKGLEWVA
VISYDGSNKYYADSVKGRFTISRDNSKNTLYLQMNSLRAEDTAVYYCAR
AGSGNYYNWFDPWGQGTLVTVSS

489-VL
(SEQ ID NO: 1124)
EIVMTQSPATLSVSPGERATLSCRASQTVSSNLVWYQQKPGQAPRLLIY
GASTRATGIPARFSGSGSGTEFTLTISSLQSEDFAVYYCQQYNNWPPYT
FGQGTKLEIK

511-VH
(SEQ ID NO: 1167)
QLQLQESGPGLVKPSETLSLTCTVSGGSISSSSYYWGWIRQPPGKGLEW
IGSIYYSGSTYYNPSLKSRVTISVDTSKNQFSLKLSSVTAADTAVYYCA
SEKVDFWSGGPYYGMDVWGQGTTVTVSS

511-VL
(SEQ ID NO: 1168)
QSALTQPASVSGSPGQSITISCTGTSSDVGSYNYVSWYQQHPGKAPKLM
IYEVSNRPSGVSNRFSGSKSGNTASLTISGLQAEDEADYYCSSYTSIST
LVFGGGTKLTVL

561-VH
(SEQ ID NO: 1267)
QVQLVESGGGVVQPGRSLRLSCAASGFTFSSYAMHWVRQAPGKGLEWVAV
ISYDGSNKYYADSVKGRFTISRDNSKNTLYLQMNSLRAEDTAVYYCARPL
SGSYRSAFDIWGQGTMVTVSS

561-VL
(SEQ ID NO: 1268)
EIVMTQSPATLSVSPGERATLSCRASQSVSSNLAWYQQKPGQAPRLLIYG
ASTRATGIPARFSGSGSGTEFTLTISSLQSEDFAVYYCQQYNNWPPRTFG
QGTKVEIK

585-VH
(SEQ ID NO: 1313)
QVQLVESGGGVVQPGRSLRLSCAASGFTFATYAMHWVRQAPGKGLEWVAL
ISHDGSNKHYADSVKGRFTISRDNSKKTLYLQMNSLRAEGTAIYYCARES
LEAAAPPFDYWGQGTLVTVSS

585-VL
(SEQ ID NO: 1314)
SYELTQPPSVSVSPGQTATIICSGDKLGEKYASWYQQKPGQSPALVIYQD
RKRPSGIPERFSGSNSGNTATLTISGTQAMDEADYYCQAWDSSNSVVFGG
GTKLTVP

In other embodiments, such anti-coronavirus antibodies (e.g., anti-SARS-CoV-2 antibodies) comprise a heavy chain comprising SEQ ID NO: 5575 and a light chain comprising SEQ ID NO: 5576. In other embodiments, such antibodies comprise a heavy chain comprising SEQ ID NO: 5577 and a light chain comprising SEQ ID NO: 5578. In other embodiments, such antibodies comprise a heavy chain comprising SEQ ID NO: 5579 and a light chain comprising SEQ ID NO: 5580. In other embodiments, such antibodies comprise a heavy chain comprising SEQ ID NO: 5581 and a light chain comprising SEQ ID NO: 5582. In other embodiments, such antibodies comprise a heavy chain comprising SEQ ID NO: 5583 and a light chain comprising SEQ ID NO: 5584. In other embodiments, such antibodies comprise a heavy chain comprising SEQ ID NO: 5585 and a light chain comprising SEQ ID NO: 5586. In other embodiments, such antibodies comprise a heavy chain comprising SEQ ID NO: 5587 and a light chain comprising SEQ ID NO: 5588. In other embodiments, such antibodies comprise a heavy chain comprising SEQ ID NO: 5589 and a light chain comprising SEQ ID NO: 5590. In other embodiments, such antibodies comprise a heavy chain comprising SEQ ID NO: 5591 and a light chain comprising SEQ ID NO: 5592. Anti-SARS-CoV-2 antibodies comprising the complete heavy and light chains of mAbs 851, 894, 896, 923, 936, 970, 1015, 1036, 1037, 1075, 1130, 1135, 1139, 1149, 1404, 1444, 1495, 1538, and 1585 are also particularly contemplated.

The amino acid sequences of some of the antibodies described in the preceding paragraph have been previously described. The others are provided below.

```
258 Heavy chain full length sequence
                                                        (SEQ ID NO: 5575)
QVQLQESGPGLVKPSETLSLTCTVSGGSISSYYWSWIRQPAGKGLEWIGRIYTSGSTNYNPSLKSRVTMSVD

TSKNQFSLKLSSVTAADTAVYYCAAGYGSIDYWGQGTLVTVSSASTKGPSVFPLAPSSKSTSGGTAALGCL

VKDYFPEPVTVSWNSGALTSGVHTFPAVLQSSGLYSLSSVVTVPSSSLGTQTYICNVNHKPSNTKVDKRVE

PKSCDKTHTCPPCPAPELLGGPSVFLFPPKPKDTLMISRTPEVTCVVVDVSHEDPEVKFNWYVDGVEVHNA

KTKPREEQYNSTYRVVSVLTVLHQDWLNGKEYKCKVSNKALPAPIEKTISKAKGQPREPQVYTLPPSREEM

TKNQVSLTCLVKGFYPSDIAVEWESNGQPENNYKTTPPVLDSDGSFFLYSKLTVDKSRWQQGNVFSCSVM

HEALHNHYTQKSLSLSPGK

258 Light chain full length sequence
                                                        (SEQ ID NO: 5576)
DIVMTQSPLSLPVTPGEPASISCRSSQSLLHSNGYNYLDWYLQKPGQSPQLLIYLGSNRASGVPDRFSGSGSG

TDFTLKISRVEAEDVGVYYCMQALQTPRTFGQGTKLEIKRTVAAPSVFIFPPSDEQLKSGTASVVCLLNNFY

PREAKVQWKVDNALQSGNSQESVTEQDSKDSTYSLSSTLTLSKADYEKHKVYACEVTHQGLSSPVTKSFN

RGEC

291 Heavy chain full length sequence
                                                        (SEQ ID NO: 5577)
QVQLVESGGGVVQPGRSLRLSCAASGFTFSSYAMHWVRQAPGKGLEWVAVISYDGSNKYYADSVKGRFT

ISRDNSKNTLYLQMNSLRAEDTAVYYCARASGGSYFGGMDVWGQGTTVTVSSASTKGPSVFPLAPSSKST

SGGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

291 Light chain full length sequence
                                                        (SEQ ID NO: 5578)
QSALTQPASVSGSPGQSITISCTGTSSDVGGYNYVSWYQQHPGKAPKLMIYEVSNRPSGVSNRFSGSKSGNT

ASLTISGLQAEDEADYYCSSYTSSSTLYVFGTGTKVTVLGQPKAAPSVTLFPPSSEELQANKATLVCLISDFY

PGAVTVAWKADSSPVKAGVETTTPSKQSNNKYAASSYLSLTPEQWKSHRSYSCQVTHEGSTVEKTVAPTE

CS

308 Heavy chain full length sequence
                                                        (SEQ ID NO: 5579)
QLQLQESGPGLVKPSETLSLTCSVSGGSISSSSYHWGWIRQPPGKGLEWIGSIYYSGSTYYNPSLKSRVTISV

DTSKNQFSLKLRSVTAADTAVYYCAGLRVVITFGGVIPKGGAFDIWGQGTMVTVSSASTKGPSVFPLAPSS

KSTSGGTAALGCLVKDYFPEPVTVSWNSGALTSGVHTFPAVLQSSGLYSLSSVVTVPSSSLGTQTYICNVNH

KPSNTKVDKRVEPKSCDKTHTCPPCPAPELLGGPSVFLFPPKPKDTLMISRTPEVTCVVVDVSHEDPEVKFN

WYVDGVEVHNAKTKPREEQYNSTYRVVSVLTVLHQDWLNGKEYKCKVSNKALPAPIEKTISKAKGQPRE

PQVYTLPPSREEMTKNQVSLTCLVKGFYPSDIAVEWESNGQPENNYKTTPPVLDSDGSFFLYSKLTVDKSR

WQQGNVFSCSVMHEALHNHYTQKSLSLSPGK
```

```
308 Light chain full length sequence
                                                    (SEQ ID NO: 5580)
QSALTQPASVSGSPGQSITISCTGTSSDVGGYNYVSWYQQHPGKAPKLMIYDVSNRPSGVSNRFSGSKSGNT

ASLTISGLQAEDEADYYCSSYTSSSTVVFGGGTKLTVLGQPKAAPSVTLFPPSSEELQANKATLVCLISDFYP

GAVTVAWKADSSPVKAGVETTTPSKQSNNKYAASSYLSLTPEQWKSHRSYSCQVTHEGSTVEKTVAPTEC

S

361 Heavy chain full length sequence
                                                    (SEQ ID NO: 5581)
QVQLQESGPGLVKPSQTLSLTCTVSGGSISSGGYYWSWIRQHPGKGLEWIGYIYYSGSTYYNPSLKSRVTIS

VDTSKNQFSLKLSSVTAADTAVYYCATTMVRGVIRLDHYGMDVWGQGTTVTVSSASTKGPSVFPLAPSSK

STSGGTAALGCLVKDYFPEPVTVSWNSGALTSGVHTFPAVLQSSGLYSLSSVVTVPSSSLGTQTYICNVNHK

PSNTKVDKRVEPKSCDKTHTCPPCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQ

QGNVFSCSVMHEALHNHYTQKSLSLSPGK

361 Light chain full length sequence
                                                    (SEQ ID NO: 5582)
QSALTQPASVSGSPGQSITISCTGTSSDVGGYNYVSWYQQHPGKAPKLMIYEVSNRPSGVSNRFSGSKSGNT

ASLTISGLQAEDEADYYCSSYTSSSTLLFGTGTKVTVLGQPKAAPSVTLFPPSSEELQANKATLVCLISDFYP

GAVTVAWKADSSPVKAGVETTTPSKQSNNKYAASSYLSLTPEQWKSHRSYSCQVTHEGSTVEKTVAPTEC

S

463 Heavy chain full length sequence
                                                    (SEQ ID NO: 5583)
QVQLVESGGGVVQPGRSLRLSCVASGFTFSSYAMHWVRQAPGKGLEWVAVISYDGSNKYYADSVKGRFT

ISRDNSKNTLYLQMNSLRAEDTAVYYCARDRVGGYSYLFDYWGQGTLVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

463 Light chain full length sequence
                                                    (SEQ ID NO: 5584)
DIVMTQSPDSLAVSLGERATINCKSSQSVLYSSNNKNYLAWYQQKPGQPPKLLIYWASTRESGVPDRFSGS

GSGTDFTLTISSLQAEDVAVYYCQQYYSTPPTFGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTKS

FNRGEC

489 Heavy chain full length sequence
                                                    (SEQ ID NO: 5585)
QVQLVESGGGVVQPGRSLRLSCAASGFTFSSYAMHWVRQAPGKGLEWVAVISYDGSNKYYADSVKGRFT

ISRDNSKNTLYLQMNSLRAEDTAVYYCARAGSGNYYNWFDPWGQGTLVTVSSASTKGPSVFPLAPSSKST

SGGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK
```

```
489 Light chain full length sequence
                                                          (SEQ ID NO: 5586)
EIVMTQSPATLSVSPGERATLSCRASQTVSSNLVWYQQKPGQAPRLLIYGASTRATGIPARFSGSGSGTEFTL

TISSLQSEDFAVYYCQQYNNWPPYTFGQGTKLEIKRTVAAPSVFIFPPSDEQLKSGTASVVCLLNNFYPREA

KVQWKVDNALQSGNSQESVTEQDSKDSTYSLSSTLTLSKADYEKHKVYACEVTHQGLSSPVTKSFNRGEC

511 Heavy chain full length sequence
                                                          (SEQ ID NO: 5587)
QLQLQESGPGLVKPSETLSLTCTVSGGSISSSSYYWGWIRQPPGKGLEWIGSIYYSGSTYYNPSLKSRVTISV

DTSKNQFSLKLSSVTAADTAVYYCASEKVDFWSGGPYYGMDVWGQGTTVTVSSASTKGPSVFPLAPSSKS

TSGGTAALGCLVKDYFPEPVTVSWNSGALTSGVHTFPAVLQSSGLYSLSSVVTVPSSSLGTQTYICNVNHKP

SNTKVDKRVEPKSCDKTHTCPPCPAPELLGGPSVFLFPPKPKDTLMISRTPEVTCVVVDVSHEDPEVKFNW

YVDGVEVHNAKTKPREEQYNSTYRVVSVLTVLHQDWLNGKEYKCKVSNKALPAPIEKTISKAKGQPREPQ

VYTLPPSREEMTKNQVSLTCLVKGFYPSDIAVEWESNGQPENNYKTTPPVLDSDGSFFLYSKLTVDKSRWQ

QGNVFSCSVMHEALHNHYTQKSLSLSPGK

511 Light chain full length sequence
                                                          (SEQ ID NO: 5588)
QSALTQPASVSGSPGQSITISCTGTSSDVGSYNYVSWYQQHPGKAPKLMIYEVSNRPSGVSNRFSGSKSGNT

ASLTISGLQAEDEADYYCSSYTSISTLVFGGGTKLTVLGQPKAAPSVTLFPPSSEELQANKATLVCLISDFYP

GAVTVAWKADSSPVKAGVETTTPSKQSNNKYAASSYLSLTPEQWKSHRSYSCQVTHEGSTVEKTVAPTEC

S

561 Heavy chain full length sequence
                                                          (SEQ ID NO: 5589)
QVQLVESGGGVVQPGRSLRLSCAASGFTFSSYAMHWVRQAPGKGLEWVAVISYDGSNKYYADSVKGRFT

ISRDNSKNTLYLQMNSLRAEDTAVYYCARPLSGSYRSAFDIWGQGTMVTVSSASTKGPSVFPLAPSSKSTS

GGTAALGCLVKDYFPEPVTVSWNSGALTSGVHTFPAVLQSSGLYSLSSVVTVPSSSLGTQTYICNVNHKPS

NTKVDKRVEPKSCDKTHTCPPCPAPELLGGPSVFLFPPKPKDTLMISRTPEVTCVVVDVSHEDPEVKFNWY

VDGVEVHNAKTKPREEQYNSTYRVVSVLTVLHQDWLNGKEYKCKVSNKALPAPIEKTISKAKGQPREPQV

YTLPPSREEMTKNQVSLTCLVKGFYPSDIAVEWESNGQPENNYKTTPPVLDSDGSFFLYSKLTVDKSRWQQ

GNVFSCSVMHEALHNHYTQKSLSLSPGK

561 Light chain full length sequence
                                                          (SEQ ID NO: 5590)
EIVMTQSPATLSVSPGERATLSCRASQSVSSNLAWYQQKPGQAPRLLIYGASTRATGIPARFSGSGSGTEFTL

TISSLQSEDFAVYYCQQYNNWPPRTFGQGTKVEIKRTVAAPSVFIFPPSDEQLKSGTASVVCLLNNFYPREA

KVQWKVDNALQSGNSQESVTEQDSKDSTYSLSSTLTLSKADYEKHKVYACEVTHQGLSSPVTKSFNRGEC

585 Heavy chain full length sequence
                                                          (SEQ ID NO: 5591)
QVQLVESGGGVVQPGRSLRLSCAASGFTFATYAMHWVRQAPGKGLEWVALISHDGSNKHYADSVKGRFT

ISRDNSKKTLYLQMNSLRAEGTAIYYCARESLEAAAPPFDYWGQGTLVTVSSASTKGPSVFPLAPSSKSTSG

GTAALGCLVKDYFPEPVTVSWNSGALTSGVHTFPAVLQSSGLYSLSSVVTVPSSSLGTQTYICNVNHKPSNT

KVDKRVEPKSCDKTHTCPPCPAPELLGGPSVFLFPPKPKDTLMISRTPEVTCVVVDVSHEDPEVKFNWYVD

GVEVHNAKTKPREEQYNSTYRVVSVLTVLHQDWLNGKEYKCKVSNKALPAPIEKTISKAKGQPREPQVYT

LPPSREEMTKNQVSLTCLVKGFYPSDIAVEWESNGQPENNYKTTPPVLDSDGSFFLYSKLTVDKSRWQQGN

VFSCSVMHEALHNHYTQKSLSLSPGK
```

```
585 Light chain full length sequence
                                                        (SEQ ID NO: 5592)
SYELTQPPSVSVSPGQTATIICSGDKLGEKYASWYQQKPGQSPALVIYQDRKRPSGIPERFSGSNSGNTATLT

ISGTQAMDEADYYCQAWDSSNSVVFGGGTKLTVPGQPKAAPSVTLFPPSSEELQANKATLVCLISDFYPGA

VTVAWKADSSPVKAGVETTTPSKQSNNKYAASSYLSLTPEQWKSHRSYSCQVTHEGSTVEKTVAPTECS
```

Exemplary activity or function that can be modulated include changes in cell morphology, expression of a marker, differentiation or de-differentiation, maturation, proliferation, viability, apoptosis or cell death neuronal progenitor cells or progeny thereof.

Methods of screening and identifying agents and compounds include those suitable for high-throughput screening, which include arrays of cells (e.g., microarrays) positioned or placed, optionally at pre-determined locations or addresses. High-throughput robotic or manual handling methods can probe chemical interactions and determine levels of expression of many genes in a short period of time. Techniques have been developed that utilize molecular signals (e.g., fluorophores) and automated analyses that process information at a very rapid rate.

Such screening methods (e.g., high-throughput) can identify active agents and compounds rapidly and efficiently. For example, cells can be positioned or placed (pre-seeded) on a culture dish, tube, flask, roller bottle or plate (e.g., a single multi-well plate or dish such as an 8, 16, 32, 64, 96, 384 and 1536 multi-well plate or dish), optionally at defined locations, for identification of potentially therapeutic molecules. Libraries that can be screened include, for example, small molecule libraries, phage display libraries, fully human antibody yeast display libraries, siRNA libraries, and adenoviral transfection vectors.

Pharmaceutical Compositions and Therapeutic Uses

Provided herein are methods of treating or preventing a SARS-CoV or SARS-CoV-2-linked disease (e.g., COVID-19) by administering to a patient a therapeutically effective amount of one or more anti-coronavirus antibodies (e.g., anti-SARS-CoV-2 antibodies) described herein, or a pharmaceutical composition comprising one or more (e.g., two or three) anti-coronavirus antibodies (e.g., anti-SARS-CoV-2 antibodies) described herein.

As used interchangeably herein, "treatment" or "treating" or "treat" refers to all processes wherein there may be a slowing, interrupting, arresting, controlling, stopping, alleviating or ameliorating symptoms or complications, or reversing of the progression of the disorders or disease disclosed herein, e.g., SARS-CoV-2 viral infection or COVID-19 disease, but does not necessarily indicate a total elimination of all disease or disorder symptoms.

As used herein, "prevention", "prevent", and/or "preventing", which are used interchangeably herein, refers to the prophylactic treatment of a disease or disorder, or delaying the onset or progression of the disease or disorder, e.g., SARS-CoV-2 viral infection or COVID-19 disease.

In some embodiments, methods of treating or preventing a SARS-CoV or SARS-CoV-2-linked disease (e.g., COVID-19) comprise administering to a patient a pharmaceutical composition comprising one or more (e.g., two or three) anti-SARS-CoV-2 antibodies described herein. In some embodiments, such methods comprise administering to a patient a pharmaceutical composition comprising two or three anti-SARS-CoV-2 antibodies or antigen-binding fragments thereof that bind different epitopes of the SARS-CoV-2 S protein. In some embodiments, such methods comprise administering to a patient a pharmaceutical composition comprising two or three anti-SARS-CoV-2 antibodies, wherein at least one of the antibodies is selected from antibodies 258 to 577 and 589 to 1587. In some embodiments, such methods comprise administering to a patient a pharmaceutical composition comprising two or three anti-SARS-CoV-2 antibodies, wherein at least one of the antibodies is selected from antibodies 292, 309, 364, 373, 388, 408, 414, 417, 419, 442, 445, 447, 462, 479, 481, 483, 488, 494, 506, 540, 549, 553, 555, 562, 851, 894, 896, 923, 936, 970, 1015, 1036, 1037, 1075, 1130, 1135, 1139, 1149, 1404, 1444, 1495, 1538, or 1585. In some embodiments, such methods comprise administering to a patient a pharmaceutical composition comprising two or three anti-SARS-CoV-2 antibodies, wherein at least one of the antibodies is 555. In some embodiments, such methods comprise administering to a patient a pharmaceutical composition comprising two or three anti-SARS-CoV-2 antibodies, wherein at least one of the antibodies is 1404. In some embodiments, such methods comprise administering to a patient a pharmaceutical composition comprising two or three anti-SARS-CoV-2 antibodies, wherein at least one of the antibodies neutralize SARS-CoV-2. In some embodiments, such methods comprise administering to a patient a pharmaceutical composition comprising two or three anti-SARS-CoV-2 antibodies, wherein at least one antibody or antigen-binding fragment thereof blocks SARS-CoV-2 binding to ACE2. In some embodiments, such methods comprise administering to a patient a pharmaceutical composition comprising two or three anti-SARS-CoV-2 antibodies, wherein at least one antibody or antigen-binding fragment thereof binds the RBD of the SARS-CoV-2 S protein. In some embodiments, such methods comprise administering to a patient a pharmaceutical composition comprising two or three anti-SARS-CoV-2 antibodies, wherein at least one antibody or antigen-binding fragment thereof binds the NTD domain of the SARS-CoV-2 S protein. In some embodiments, such methods comprise administering to a patient a pharmaceutical composition comprising two or three anti-SARS-CoV-2 antibodies, wherein at least one antibody or antigen-binding fragment thereof binds the S2 domain of the SARS-CoV-2 S protein. In some embodiments, such methods comprise administering to a patient a pharmaceutical composition comprising two or three anti-SARS-CoV-2 antibodies, wherein at least one antibody or antigen-binding fragment thereof binds the RBD of the SARS-CoV-2 S protein and at least one antibody or antigen-binding fragment thereof binds the NTD or S2 domain of the SARS-CoV-2 S protein.

In some embodiments, provided herein are methods of treating or preventing a SARS-CoV-2-linked disease (e.g., COVID-19) comprising administering to a patient an antibody comprising a heavy chain comprising SEQ ID NO: 5363 and a light chain comprising SEQ ID NO: 5364, or a pharmaceutical composition comprising such an antibody. In some embodiments, such methods further comprise administering to the patient another antibody that binds the SARS-CoV-2 S protein (e.g., CB-6 or 1404). In some embodiments, provided herein are methods of treating or preventing a SARS-CoV-2-linked disease (e.g., COVID-19) comprising administering to a patient a pharmaceutical composition comprising an antibody that comprises a heavy chain comprising SEQ ID NO: 5363 and a light chain comprising SEQ ID NO: 5364, and at least one additional antibody that binds SARS-CoV-2 (e.g., CB6 or 1404).

In some embodiments, provided herein are methods of treating or preventing a SARS-CoV-2-linked disease (e.g., COVID-19) comprising administering to a patient an antibody comprising a heavy chain comprising SEQ ID NO: 5735 and a light chain comprising SEQ ID NO: 5736, or a pharmaceutical composition comprising such an antibody. In some embodiments, such methods further comprise administering to the patient another antibody that binds the SARS-CoV-2 S protein (e.g., 555 or CB-6). In some embodiments, provided herein are methods of treating or preventing a SARS-CoV-2-linked disease (e.g., COVID-19) comprising administering to a patient a pharmaceutical composition comprising an antibody that comprises a heavy chain comprising SEQ ID NO: 5735 and a light chain comprising SEQ ID NO: 5736, and at least one additional antibody that binds SARS-CoV-2 (e.g., 555 or CB6).

In some embodiments, provided herein are methods of preventing COVID-19 comprising administering to a patient who is at risk for contracting COVID-19 an antibody that comprises a heavy chain comprising SEQ ID NO: 5363 and a light chain comprising SEQ ID NO: 5364, or a pharmaceutical composition comprising such an antibody. In some embodiments, such methods further comprise administering to the patient another antibody that binds the SARS-CoV-2 S protein (e.g., CB-6 or 1404).

In some embodiments, provided herein are methods of treating or preventing a SARS-CoV-2-linked disease (e.g., COVID-19) comprising administering to a patient an antibody that comprises a heavy chain comprising SEQ ID NO: 5735 and a light chain comprising SEQ ID NO: 5736, or a pharmaceutical composition comprising such an antibody. In some embodiments, such methods further comprise administering to the patient another antibody that binds the SARS-CoV-2 S protein (e.g., 555 or CB-6). In some embodiments, provided herein are methods of treating or preventing a SARS-CoV-2-linked disease (e.g., COVID-19) comprise administering to a patient a pharmaceutical composition comprising an antibody that comprises a heavy chain comprising SEQ ID NO: 5735 and a light chain comprising SEQ ID NO: 5736, and at least one additional antibody that binds SARS-CoV-2 (e.g., 555 or CB6).

In some embodiments, provided herein are methods of preventing COVID-19 comprising administering to a patient who is at risk for contracting COVID-19 an antibody that comprises a heavy chain comprising SEQ ID NO: 5735 and a light chain comprising SEQ ID NO: 5736, or a pharmaceutical composition comprising such an antibody. In some embodiments, such methods further comprise administering to the patient another antibody that binds the SARS-CoV-2 S protein (e.g., 555 or CB-6).

In some embodiments, provided herein are methods of reducing COVID-19 related hospitalization or Emergency Room (ER) visit of a patient having COVID-19 by administering to the patient a therapeutically effective amount of an anti-SARS-CoV-2 antibody described herein or a pharmaceutical composition comprising such an antibody. In some embodiments, provided herein are methods of reducing COVID-19 related hospitalization or ER visit of a patient having COVID-19 by administering to the patient a therapeutically effective amount of an antibody comprises a heavy chain comprising SEQ ID NO: 5363 and a light chain comprising SEQ ID NO: 5364, or a pharmaceutical composition comprising such an antibody. In some embodiments, provided herein are methods of reducing COVID-19 related hospitalization or ER visit of a patient having COVID-19 by administering to the patient a therapeutically effective amount of an antibody that comprises a heavy chain comprising SEQ ID NO: 5363 and a light chain comprising SEQ ID NO: 5364, and another anti-SARS-CoV-2 antibody (e.g., an antibody that binds the SARS-CoV-2 S protein such as CB6 or 1404). In some embodiments, provided herein are methods of reducing COVID-19 related hospitalization or ER visit of a patient having COVID-19 by administering to the patient a therapeutically effective amount of an antibody that comprises a heavy chain comprising SEQ ID NO: 5735 and a light chain comprising SEQ ID NO: 5736, and another anti-SARS-CoV-2 antibody (e.g., an antibody that binds the SARS-CoV-2 S protein such as 555 or CB6).

In some embodiments, provided herein are methods of treating or preventing COVID-19 comprising: contacting a sample obtained from a patient with an antibody or antigen-binding fragment thereof described herein, conjugated to a detectable agent; detecting specific binding of the antibody or antigen-binding fragment thereof to a SARS-CoV-2 antigen present in the sample; and administering to the patient a therapeutically effective amount of an antibody or antigen-binding fragment thereof described herein or a pharmaceutical composition comprising such an antibody or antigen-binding fragment thereof.

In some embodiments, the patient has moderate to severe COVID-19, but is not hospitalized. In some embodiments, the patient has mild to moderate COVID-19. For example, mild COVID-19 patients can include individuals who have any of various signs and symptoms, e.g., fever, cough, sore throat, malaise, headache, muscle pain, without shortness of breath, dyspnea, or abnormal imaging. Moderate COVID-19 patients can include individuals who have evidence of lower respiratory disease by clinical assessment or imaging and a saturation of oxygen (SaO2) greater than (>)93 percent (%) on room air at sea level. In some embodiments, the patient is at risk for contracting COVID-19. In some embodiments, the patient has a positive SARS-CoV-2 viral testing result. In some embodiments, the patient is an adult or pediatric patient who is 12 years of age and older and weigh at least 40 kilograms (kg). In some embodiments, the patient is at high risk for progressing to severe COVID-19 and/or hospitalization, e.g., the patient (i) is 65 years of age or older (≥65); (ii) has a body mass index (BMI) of 35 or greater (≥35); (iii) has chronic kidney disease; (iv) has diabetes; (v) has immunosuppressive disease, (vi) is receiving immunosuppressive treatment; (vii) is 55 years of age or older (≥55) and has cardiovascular disease, hypertension, chronic obstructive pulmonary disease, or other chronic respiratory disease; or (viii) is 12-17 years of age and have a BMI≥85% for their age and gender, or sickle cell disease, congenital or acquired heart disease, neurodevelopmental disorders (e.g., cerebral palsy), a medical-related technological dependence (e.g., tracheostomy, gastrostomy, or positive pressure ventilation not related to COVID-19), or asthma, reactive airway or other chronic respiratory disease that requires daily medication for control. In some embodiments, the patient has mild to moderate COVID-19 and the patient is at high risk for progressing to severe COVID-19 and/or hospitalization, e.g., the patient (i) is 65 years of age or older (≥65); (ii) has a body mass index (BMI) of 35 or greater (≥35); (iii) has chronic kidney disease; (iv) has diabetes; (v) has immunosuppressive disease, (vi) is receiving immunosuppressive treatment; (vii) is 55 years of age or older (≥55) and has cardiovascular disease, hypertension, chronic obstructive pulmonary disease, or other chronic respiratory disease; or (viii) is 12-17 years of age and have a BMI≥85% for their age and gender, or sickle cell disease, congenital or acquired heart disease, neurodevelopmental disorders (e.g., cerebral palsy), a medical-related technological dependence (e.g., tracheostomy, gastrostomy, or positive pressure ventilation not related to COVID-19), or asthma, reactive airway or other chronic respiratory disease that requires daily medication for control.

Also provided are anti-coronavirus antibodies (e.g., anti-SARS-CoV-2 antibodies) or antigen-binding fragments or pharmaceutical compositions comprising one or more (e.g., two or three) anti-coronavirus antibodies (e.g., anti-SARS-CoV-2 antibodies) or antigen-binding fragments, for use in therapy. In some embodiments anti-SARS-CoV-2 antibodies or antigen-binding fragments or pharmaceutical compositions comprise one or more (e.g., two or three) anti-SARS-CoV-2 antibodies or antigen-binding fragments, for use in the treatment or prevention of COVID-19. Further provided herein are uses of anti-coronavirus antibodies (e.g., anti-SARS-CoV-2 antibodies) or antigen-binding fragments described herein in the manufacture of a medicament for the treatment or prevention of COVID-19.

Depending on the form of anti-coronavirus antibody (e.g., anti-SARS-CoV-2 antibody), mode of intended delivery, and numerous other variables, anti-coronavirus antibodies (e.g., anti-SARS-CoV-2 antibodies) disclosed herein may be formulated as desired using art recognized techniques. Various pharmaceutically acceptable carriers, which include vehicles, adjuvants, and diluents, are readily available from numerous commercial sources. Moreover, an assortment of pharmaceutically acceptable auxiliary substances, such as pH adjusting and buffering agents, tonicity adjusting agents, stabilizers, wetting agents, and the like, are also available. Certain non-limiting exemplary carriers include saline, buffered saline, dextrose, water, glycerol, ethanol, and combinations thereof.

In some embodiments, anti-coronavirus antibodies (e.g., anti-SARS-CoV-2 antibodies) may be administered to a patient neat or with a minimum of additional components. In other embodiments, anti-coronavirus antibodies (e.g., anti-SARS-CoV-2 antibodies) may be formulated to contain suitable pharmaceutically acceptable carriers comprising excipients and auxiliaries that are well known in the art and are relatively inert substances that facilitate administration or which aid processing of the active compounds into preparations that are pharmaceutically optimized for delivery. For example, an excipient can give form or consistency or act as a diluent to improve the pharmacokinetics of the antibody. Suitable excipients include but are not limited to stabilizing agents, wetting, and emulsifying agents, salts for varying osmolality, encapsulating agents, buffers, and skin penetration enhancers.

Anti-coronavirus antibodies (e.g., anti-SARS-CoV-2 antibodies) disclosed herein may be formulated for enteral, parenteral, or topical administration. Indeed, all three types of formulation may be used simultaneously to achieve systemic administration of the active ingredient. Excipients as well as formulations for parenteral and non-parenteral drug delivery are known in the art. Suitable formulations for parenteral administration include aqueous solutions of the active compounds in water-soluble form, for example, water-soluble salts. In addition, suspensions of the active compounds as appropriate for oily injection suspensions may be administered. Suitable lipophilic solvents or vehicles include fatty oils, for example, sesame oil, or synthetic fatty acid esters, for example, ethyl oleate or triglycerides. Aqueous injection suspensions may contain substances that increase the viscosity of the suspension and include, for example, sodium carboxymethyl cellulose, sorbitol, and/or dextran. Optionally, the suspension may also contain stabilizers. Liposomes can also be used to encapsulate the agent for delivery into the cell.

Suitable formulations for enteral administration include hard or soft gelatin capsules, pills, tablets, including coated tablets, elixirs, suspensions, syrups or inhalations and controlled release forms thereof.

In some embodiments, anti-coronavirus antibodies (e.g., anti-SARS-CoV-2 antibodies) may be adsorbed onto red blood cells to facilitate preferential delivery to the lungs preventing a shortened half-life through processing in the liver and spleen and providing a higher concentration in the lungs.

In general, anti-coronavirus antibodies (e.g., anti-SARS-CoV-2 antibodies) disclosed herein may be administered in vivo, to a subject in need thereof, by various routes, including, but not limited to, oral, intravenous, intra-arterial, subcutaneous, parenteral, intranasal, intramuscular, intracardiac, intraventricular, intratracheal, buccal, rectal, intraperitoneal, intradermal, topical, transdermal, and intrathecal, or otherwise by implantation or inhalation. Compositions may be formulated into preparations in solid, semi-solid, liquid, or gaseous forms; including, but not limited to, tablets, capsules, powders, granules, ointments, solutions, suppositories, enemas, injections, inhalants, and aerosols. The appropriate formulation and route of administration may be selected according to the intended application and therapeutic regimen.

In some embodiments, the pharmaceutical compositions described herein comprise one or more anti-SARS-CoV-2 antibodies. In some embodiments, the pharmaceutical compositions further comprise one or more of the following excipients: histidine, sodium chloride, sucrose, polysorbate 80. In some embodiments, the pharmaceutical compositions comprise at least one anti-SARS-CoV-2 antibody (e.g., 555 or 1404), histidine, sodium chloride, sucrose, polysorbate 80. In some embodiments, the pharmaceutical compositions have a pH of about 6.0. In some embodiments, the pharmaceutical composition comprises at least one anti-SARS-CoV-2 antibody (e.g., 555 or 1404), 5 mM histidine, 50 mM NaCl, 6% sucrose, and 0.05% polysorbate 80 and has a pH of about 6.0. In some embodiments, the anti-SARS-CoV-2 antibody concentration in the pharmaceutical composition is about 10 mg/mL to about 150 mg/mL. In some embodiments, the anti-SARS-CoV-2 antibody concentration in the pharmaceutical composition is about 35 mg/mL to about 125 mg/mL. In some embodiments, the anti-SARS-CoV-2 antibody concentration in the pharmaceutical composition is about 35 mg/mL. In some embodiments, the anti-SARS-CoV-2 antibody concentration in the pharmaceutical composition is about 125 mg/mL.

Similarly, the particular dosage regimen, i.e., dose, timing, and repetition, will depend on the particular individual and that individual's medical history. Empirical considerations such as pharmacokinetics (e.g., half-life, clearance rate, etc.) will contribute to the determination of the dosage. Frequency of administration may be determined and adjusted over the course of therapy, and is based on reducing the number of hyperproliferative or neoplastic cells, including tumor initiating cells, maintaining the reduction of such neoplastic cells, reducing the proliferation of neoplastic cells, or delaying the development of metastasis. Alternatively, sustained continuous release formulations of a subject therapeutic composition may be appropriate. Various formulations and devices for achieving sustained release are known in the art.

Pharmaceutical compositions are administered in therapeutically effective amount for treatment or prophylaxis of a coronavirus infection. As used herein, the term "therapeutically effective amount" means that amount of an anti-coronavirus antibody (e.g., anti-SARS-CoV-2 antibody) or pharmaceutical composition comprising the same that will elicit the biological or medical response in a subject that is sought by a medical doctor or other clinician. In particular, with regard to viral infections and proliferation of virus, a "therapeutically effective amount" is intended to include an amount sufficient to achieve one or more of the following effects: (i) reduction or amelioration the severity of a viral infection, viral disease or a symptom associated therewith; (ii) reduction in the duration of a viral infection, viral disease, or a symptom associated therewith; (iii) prevention of the progression of a viral infection, viral disease, or a symptom associated therewith; (iv) regression of a viral infection, viral disease, or a symptom associated therewith; (v) prevention of the development or onset of a viral infection, viral disease, or a symptom associated therewith; (vi) prevention of the recurrence of a viral infection, viral disease, or a symptom associated therewith; (vii) reduction or prevention of the spread of coronavirus from one cell to another cell, one tissue to another tissue, or one organ to another organ; (viii) prevention or reduction of the spread/transmission of coronavirus from one subject to another subject; (ix) reduction in organ failure associated with a viral infection or viral disease; (x) reduction in the hospitalization of a subject; (xi) reduction in the hospitalization length; (xii) an increase in the survival of a subject with coronavirus infection or a disease associated therewith; (xiii) elimination of a coronavirus infection or a disease associated therewith; (xiv) inhibition or reduction in viral replication; (xv) inhibition or reduction in the binding or fusion of virions to a host cell(s); (xvi) inhibition or reduction in the entry of virions into a host cell(s); (xvii) inhibition or reduction of replication of the viral genome; (xviii) inhibition or reduction in the synthesis of viral proteins; (xix) inhibition or reduction in the assembly of viral particles; (xx) inhibition or reduction in the release of viral particles from a host cell(s); (xxi) reduction in viral titer, (xxii) the reduction in the number of symptoms associated with coronavirus infection or viral disease; (xxiii) enhancement, improvement, supplementation, complementation, or augmentation of the prophylactic or therapeutic effect(s) of another therapy; (xxiv) prevention of the onset or progression of a secondary infection associated with a viral infection; (xxv) prevention of the onset or diminution of the severity of another disease occurring secondary to a coronavirus infection; and/or (xxvi) change in the immune response coronavirus infection including cytokines, chemokines, complement, cellular responses, etc.

In some embodiments, a therapeutically effective amount of an anti-coronavirus antibody (e.g., anti-SARS-CoV-2 antibody) or pharmaceutical composition comprising the same has a beneficial effect but does not cure a viral infection or a disease associated therewith. In certain embodiments, therapy may encompass the administration of multiple doses of an anti-coronavirus antibody (e.g., anti-SARS-CoV-2 antibody) or pharmaceutical composition comprising the same at a certain frequency to achieve an amount of the therapy that has a prophylactic and/or therapeutic effect.

Readily observable symptoms associated with coronavirus and other viral infections include fever, cough and/or sore throat, runny or stuffy nose, headache and/or body aches, chills, fatigue, generalized weakness, nausea, and vomiting and/or diarrhea.

A therapeutically effective amount is typically dependent on the weight of the subject being treated, his or her physical condition, the extensiveness of the condition to be treated, and the age of the subject being treated. In general, anti-coronavirus antibodies (e.g., anti-SARS-CoV-2 antibodies) disclosed herein may be administered in an amount in the range of about 10 ng/kg body weight to about 100 mg/kg body weight per dose. In certain embodiments, antibodies may be administered in an amount in the range of about 50 µg/kg body weight to about 5 mg/kg body weight per dose. In other embodiments, antibodies may be administered in an amount in the range of about 100 µg/kg body weight to about 10 mg/kg body weight per dose. In other embodiments, antibodies may be administered in an amount in the range of about 100 µg/kg body weight to about 20 mg/kg body weight per dose. In other embodiments, antibodies may be administered in an amount in the range of about 0.5 mg/kg body weight to about 20 mg/kg body weight per dose. In other embodiments, antibodies may be administered in a dose of at least about 100 µg/kg body weight, at least about 250 µg/kg body weight, at least about 750 µg/kg body weight, at least about 3 mg/kg body weight, at least about 5 mg/kg body weight, or at least about 10 mg/kg body weight.

In some embodiments, an anti-SARS-CoV-2 antibody or a pharmaceutical composition comprising such an antibody, is administered intravenously or subcutaneously to a patient at a dose of about 100 mg to about 10,000 mg. In some embodiments, an anti-SARS-CoV-2 antibody (e.g., 555 or 1404) or a pharmaceutical composition comprising such an antibody, is administered intravenously or subcutaneously to a patient at a dose of about 35 mg to about 7000 mg. In some embodiments, an anti-SARS-CoV-2 antibody (e.g., 555 or 1404) or a pharmaceutical composition comprising such an antibody, is administered intravenously or subcutaneously to a patient at a dose of about 700 mg to about 7000 mg (e.g., about 700 mg, about 750 mg, about 800 mg, about 850 mg, about 900 mg, about 950 mg, about 1000 mg, about 1100 mg, about 1200 mg, about 1300 mg, about 1400 mg, about 1500 mg, about 1600 mg, about 1700 mg, about 1800 mg, about 1900 mg, about 2000 mg, about 2100 mg, about 2200 mg, about 2300 mg, about 2400 mg, about 2500 mg, about 2600 mg, about 2700 mg, about 2800 mg, about 2900 mg, about 3000 mg, about 3100 mg, about 3200 mg, about 3300 mg, about 3400 mg, about 3500 mg, about 3600 mg, about 3700 mg, about 3800 mg, about 3900 mg, about 4000 mg, about 4100 mg, about 4200 mg, about 4300 mg, about 4400 mg, about 4500 mg, about 4600 mg, about 4700 mg, about 4800 mg, about 4900 mg, about 5000 mg, about 5100 mg, about 5200 mg, about 5300 mg, about 5400 mg, about 5500 mg, about 5600 mg, about 5700 mg, about 5800 mg, about 5900 mg, about 6000 mg, about 6100 mg, about 6200 mg, about 6300 mg, about 6400 mg, about 6500 mg, about 6600 mg, about 6700 mg, about 6800 mg, about 6900 mg, about 7000 mg). In some embodiments, an anti-SARS-CoV-2 antibody (e.g., 555 or 1404) or a pharmaceutical composition comprising such an antibody, is administered intravenously or subcutaneously to a patient at a dose of about 700 mg, 1400 mg, 2800 mg, 4200 mg, 5600 mg, or 7000 mg. In some embodiments, an anti-SARS-CoV-2 (e.g., 555 or 1404) or a pharmaceutical composition comprising such an antibody, is administered intravenously or subcutaneously to a patient at a dose of about 35 mg to about 700 mg (e.g., about 35 mg, about 70 mg, about 105 mg, about 140 mg, about 150 mg, about 175 mg, about 210 mg, about 245 mg, about 280 mg, about 315 mg, about 350 mg, 385 mg, 420 mg, 455 mg, 490 mg, 525 mg, 560 mg, 595 mg, 630 mg, 665 mg, or 700 mg). In some embodiments, an anti-SARS-CoV-2 antibody (e.g., 555 or 1404) or a pharmaceutical composition comprising such an antibody, is administered intravenously or subcutaneously to a patient at a dose of about 70 mg, 140 mg, 150 mg, 175 mg, 210 mg, 280 mg, 350 mg, 420 mg, 490 mg, 560 mg, or 630 mg. In some embodiments, an anti-SARS-CoV-2 antibody (e.g., 555 or 1404) or a pharmaceutical composition comprising such an antibody, is administered intravenously or subcutaneously to a patient at a dose of about 700 mg. In some embodiments, an anti-SARS-CoV-2 antibody (e.g., 555 or 1404) or a pharmaceutical composition comprising such an antibody, is administered intravenously or subcutaneously to a patient at a dose of about 350 mg. In some embodiments, an anti-SARS-CoV-2 antibody (e.g., 555 or 1404) or a pharmaceutical composition comprising such an antibody, is administered intravenously or subcutaneously to a patient at a dose of about 175 mg. In some embodiments, an anti-SARS-CoV-2 antibody (e.g., 555 or 1404) or a pharmaceutical composition comprising such an antibody, is administered intravenously or subcutaneously to a patient at a dose of about 150 mg.

Other dosing regimens may be predicated on Body Surface Area (BSA) calculations. As is well known in the art, a patient's BSA is calculated using the patient's height and weight and provides a measure of a subject's size as represented by the surface area of his or her body. In some embodiments, anti-coronavirus antibodies (e.g., anti-SARS-CoV-2 antibodies) disclosed herein are administered in dosages from 10 $mg/m^2$ to 800 $mg/m^2$. In other embodiments, antibodies are administered in dosages from 50 $mg/m^2$ to 500 $mg/m^2$ and even more preferably at dosages of 100 $mg/m^2$, 150 $mg/m^2$, 200 $mg/m^2$, 250 $mg/m^2$, 300 $mg/m^2$, 350 $mg/m^2$, 400 $mg/m^2$ or 450 $mg/m^2$.

Escalation for an individual patient can occur at the discretion of a clinician in the absence of any clinically significant occurrence that the clinician might reasonably believe would present an undue safety risk for the patient, such as, for example, Grade ≥3 non-hematologic toxicity, Grade ≥3 nausea, vomiting or diarrhea uncontrolled by maximum antiemetic/anti-diarrhea therapy, Grade 4 neutropenia lasting >7 days in the absence of growth factor support, Grade 3 or 4 neutropenia of any duration accompanied with fever ≥38.5° C. and/or systemic infection, or other Grade ≥4 hematologic toxicity.

Anti-coronavirus antibodies (e.g., anti-SARS-CoV-2 antibodies) disclosed herein are usually administered to the patient on multiple occasions. An exemplary treatment regimen entails administration once per every two weeks, once a month, or once every 3 to 6 months. For example, patients can receive the antibody (e.g., as an intravenous formulation) once every four weeks as a cycle, for example every twenty-eight days. The dosing frequency can be adjusted depending on the pharmacokinetic profile of the antibody in the patient. For example, the half-life of the antibody may warrant a two week frequency of dosing. In some methods, two or more antibodies with different binding specificities may be administered simultaneously, in which case the dosage of each antibody administered falls within the ranges indicated. Intervals between single dosages can be weekly, monthly, or yearly. Intervals can also be irregular depending upon levels of antibody in the blood and other clinical indicia. In some methods, the dosage is adjusted to achieve a plasma antibody concentration of about 1-1000 µg/mL or about 25-300 µg/mL. Alternatively, antibodies can be administered as a sustained release formulation, in which case less frequent administration is required. Antibodies may be administered to the patient for at least 9 months, at least 12 months, or for a longer period of time to achieve a desired result.

Dosage and frequency vary depending on the half-life of the antibody in the patient. In general, human antibodies show the longest half-life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, until a partial or complete response is achieved, and/or until the patient shows lessening or amelioration of symptoms of disease. Thereafter, the patent can be administered a prophylactic regime.

The duration of a therapeutic regimen depends on the disease being treated, the age and condition of the patient, the stage and type of the patient's disease, how the patient responds to the treatment, etc. A clinician can observe the therapy's effects closely and make any adjustments as needed. When agents are used in combination, the two or more therapeutic agents are administered simultaneously or sequentially in any order, i.e., an antibody disclosed herein is administered prior to administering a second therapeutic agent, concurrently with a second therapeutic agent, or subsequent to administration of a second therapeutic agent. For example, a combination therapy may be performed by administering a first therapeutic agent prior to (e.g., 1 minute, 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks before), concurrently with, or subsequent to (e.g., 1 minute, 5 minutes, 15 minutes, 30 minutes, 45 minutes, 1 hour, 2 hours, 4 hours, 6 hours, 12 hours, 24 hours, 48 hours, 72 hours, 96 hours, 1 week, 2 weeks, 3 weeks, 4 weeks, 5 weeks, 6 weeks, 8 weeks, or 12 weeks after) administering a second therapeutic agent.

The dosage, frequency, and mode of administration of each component of a combination therapy can be controlled independently. For example, one therapeutic agent may be administered orally three times per day, while the second therapeutic agent may be administered intramuscularly once per day. Combination therapy may be given in on-and-off cycles that include rest periods. The compounds may also be admixed or otherwise formulated together such that one administration delivers both therapeutic agents. In this case, each therapeutic agent is generally present in an amount of 1-95% by weight of the total weight of the composition. Alternatively, therapeutic agents can be formulated separately and in individual dosage amounts. Combinations of therapeutic agents for treatment can be provided as components of a pharmaceutical pack.

Preferably, combination therapies elicit a synergistic therapeutic effect, i.e., an effect greater than the sum of their individual effects or therapeutic outcomes, such as those described above. For example, a synergistic therapeutic effect may be an effect of at least about two-fold greater than sum of the therapeutic effects elicited by the single agents of a given combination, or at least about five-fold greater, or at least about ten-fold greater, or at least about twenty-fold greater, or at least about fifty-fold greater, or at least about one hundred-fold greater. A synergistic therapeutic effect may also be observed as an increase in therapeutic effect of at least 10% compared to the sum of the therapeutic effects elicited by the single agents of a given combination, or at least 20%, or at least 30%, or at least 40%, or at least 50%, or at least 60%, or at least 70%, or at least 80%, or at least 90%, or at least 100%, or more. A synergistic effect is also an effect that permits reduced dosing of therapeutic agents when they are used in combination.

Articles of Manufacture

The inventions disclosed herein also encompass pharmaceutical packs and kits comprising one or more containers and comprising one or more doses of an anti-coronavirus (e.g., anti-SARS-CoV-2 antibody) disclosed herein. In certain embodiments, a unit dosage is provided wherein the unit dosage contains a predetermined amount of a composition comprising, for example, an anti-coronavirus antibody (e.g., anti-SARS-CoV-2 antibody) disclosed herein, with or without one or more additional agents. For other embodiments, such a unit dosage is supplied in single-use prefilled syringe for injection. In still other embodiments, the composition contained in the unit dosage may comprise saline, sucrose, or the like; a buffer, such as phosphate, or the like; and/or be formulated within a stable and effective pH range. Alternatively, in certain embodiments, the composition may be provided as a lyophilized powder that may be reconstituted upon addition of an appropriate liquid, for example, sterile water. In certain preferred embodiments, the composition comprises one or more substances that inhibit protein aggregation, including, but not limited to, sucrose and arginine. Any label on, or associated with, the container(s) indicates that the enclosed composition is used for diagnosis or treatment.

The present invention also provides kits for producing single-dose or multi-dose administration units of an anti-coronavirus antibody (e.g., an anti-SARS-CoV-2 antibody) disclosed herein and, optionally, one or more other diagnostic or therapeutic agents. The kit comprises a container and a label or package insert on or associated with the container. Suitable containers include, for example, bottles, vials, syringes, etc. The containers may be formed from a variety of materials such as glass or plastic. The container holds a composition that is effective for treating the condition and may have a sterile access port (for example the container may be an intravenous solution bag or a vial having a stopper pierceable by a hypodermic injection needle). Such kits will generally contain in a suitable container a pharmaceutically acceptable formulation of the anti-coronavirus antibody (e.g., anti-SARS-CoV-2 antibodies) and, optionally, one or more other diagnostic or therapeutic agents. in the same or different containers. The kits may also contain other pharmaceutically acceptable formulations, either for diagnosis or combined therapy. Such kits may also provide appropriate reagents to conjugate the anti-coronavirus antibody (e.g., anti-SARS-CoV-2 antibodies) with the other diagnostic or therapeutic agent(s).

More specifically the kits may have a single container that contains the anti-coronavirus antibody (e.g., anti-SARS-CoV-2 antibody), with or without additional components, or they may have distinct containers for each desired agent. Where combined therapeutics are provided for conjugation, a single solution may be pre-mixed, either in a molar equivalent combination, or with one component in excess of the other. Alternatively, the anti-coronavirus antibody (e.g., anti-SARS-CoV-2 antibody) and any optional diagnostic or therapeutic agent of the kit may be maintained separately within distinct containers prior to administration to a patient. The kits may also comprise a second/third container means for containing a sterile, pharmaceutically acceptable buffer or other diluent such as bacteriostatic water for injection (BWFI), phosphate-buffered saline (PBS), Ringer's solution and dextrose solution.

When the components of the kit are provided in one or more liquid solutions, the liquid solution is preferably an aqueous solution, with a sterile aqueous solution being particularly preferred. However, the components of the kit may be provided as dried powder(s). When reagents or components are provided as a dry powder, the powder can be reconstituted by the addition of a suitable solvent. It is envisioned that the solvent may also be provided in another container.

As indicated briefly above the kits may also contain a means by which to administer the antibody and any optional components to the patient, e.g., one or more needles or syringes, or even an eye dropper, pipette, or other such like apparatus, from which the formulation may be injected or introduced into the patient. Such kits will also typically include a means for containing the vials, or such like, and other component in close confinement for commercial sale, such as, e.g., injection or blow-molded plastic containers into which the desired vials and other apparatus are placed and retained. Any label or package insert indicates that the anti-coronavirus antibody (e.g., anti-SARS-CoV-2 antibody) composition is used for treating cancer, for example colorectal cancer.

In other preferred embodiments, anti-coronavirus antibodies (e.g., anti-SARS-CoV-2 antibodies) disclosed herein may be used in conjunction with, or comprise, diagnostic or therapeutic devices useful in the diagnosis or treatment of proliferative disorders. For example, in one embodiment, anti-coronavirus antibodies (e.g., anti-SARS-CoV-2 antibodies) may be combined with certain diagnostic devices or instruments that may be used to detect, monitor, quantify or profile cells or marker compounds involved in the etiology or manifestation a coronavirus infection.

EXAMPLES

The following examples have been included to illustrate aspects of the inventions disclosed herein. In light of the present disclosure and the general level of skill in the art, those of skill appreciate that the following examples are intended to be exemplary only and that numerous changes, modifications, and alterations may be employed without departing from the scope of the disclosure.

Example 1

Isolation and Generation of Monoclonal Antibodies

Blood samples were obtained from convalescent human donors with a confirmed SARS-CoV-2 infection. The samples were enriched for antibody-secreting B-cells and screened using single cell secretion assays, to enrich for antibodies that bind to recombinant SARS-CoV-2 Spike protein using three different miniaturized single cell secretion assays: a multiplexed bead-based assay, a soluble antigen assay and a live-cell assay. The live cell assay is an ideal strategy to rapidly express and screen unknown antigens during a pandemic, without the need for recombinant protein expression and in-depth knowledge of the target.

For the bead assay, unique antibody sequences were confirmed to bind the screening target (SARS-CoV-2 full length Spike) using a multiplexed bead assay on high throughput flow cytometry. Different optically encoded bead types were conjugated to various SARS-CoV-2 antigens: full length Spike of either wildtype or reported viral mutants (S50L, A222V, N439K, F490S, S494P, D614G, B.1.1.7, B.1.351) of SARS-CoV-2 and the S1 or NTD subunits of SARS-CoV-2 Spike. To assess potential cross-reactivity of discovered antibodies, binding was also assessed to the following antigens coupled to optically encoded bead types: full length Spike of MERS, SARS-CoV, HKU1 and WIV1. Purified antibodies were incubated with the multiplexed beads, and negative control beads conjugated to BSA-His or FoldOn-His at 50 nM antibody concentration for 30 minutes at room temperature. Beads were washed and binding was detected by using a fluorescently labeled anti-human secondary antibody. Fluorescence was measured using high throughput plate-based flow cytometry. Benchmark antibodies identified to SARS-CoV were used as positive controls due to similarity in Spike sequences between SARS-CoV and SARS-CoV-2; human IgG isotype and an irrelevant antibody were used as negative controls.

For the live cell assay, unique antibody sequences were confirmed to bind the screening target (SARS-CoV-2 full length Spike) using high throughput flow cytometry. CHO cells were transiently transfected to express the full length Spike protein of either wild type SARS-CoV or SARS-CoV-2 or mutant SARS-CoV-2 (R21I, T22I, T29I, H49Y, D138H, Q490E, N439K, G476S, S477N, T478I, V483A, F490S, S494P, N501Y, G504D, A520S, D614G, B.1.1.7, B.1.351) on the cell surface. Suspension CHO cells were transiently transfected with the plasmid using electroporation. Full length native conformation Spike protein expression was confirmed by testing with benchmark antibodies discovered against SARS-CoV that target different stalk and head domains using flow cytometry. Western blot was performed with a whole cell isolate to confirm full length protein expression on the cell surface. For the soluble assay, the IgG secreted by B-cells was captured on beads using the constant region. Binding to secreted IgG immobilized onto beads was subsequently assessed using soluble fluorescently labeled SARS-CoV-2 Spike or SARS-CoV-2 RBD antigen.

Purified antibodies were incubated with the readout cells, and an untransfected control CHO line at 50 nM antibody concentration for 30 minutes at 4° C. CHO cells were washed and binding was detected by using a fluorescently labeled anti-human secondary antibody. Fluorescence was measured using high throughput plate-based flow cytometry. Benchmark antibodies identified to SARS-CoV were used as positive controls due to similarity in Spike sequences between SARS-CoV and SARS-CoV-2; human IgG isotype and an irrelevant antibody were used as negative controls. Median fluorescence intensity of each antibody was normalized over the median fluorescence intensity of the human isotype control for respective antigens. The median fold over isotype values from different validation experiments were plotted. Mean and standard deviation was calculated where applicable and the values plotted as a column bar graph with median fold over isotype on Y-axis and the different antibodies represented along the X-axis. Antibody values greater than 5-fold over isotype were considered as binders. The cut-off value was determined based on the binding to the negative controls.

Individual B-cells from chambers identified as having positive binding events (hits) were recovered from the microfluidic device, from were generated next-generation sequencing (NGS) libraries of the antibody genes from the recovered single cells and sequenced them using the MiSeq platform (Illumina, USA).

After determining the $V_H$ and $V_L$ sequences of the antigen-reactive B cells, they were converted to full-length IgG1 antibody sequences. The full-length heavy chain sequences of IgG1m3 allotype were constructed based on the VH sequences, and the full-length light chain kappa or lambda sequences were constructed based on the VL sequences. Full-length heavy chain and light chain sequences were cloned into expression vectors and recombinantly expressed.

Table 1-1 shows the results of a bead assay described above demonstrating which exemplary anti-coronavirus antibodies bind to wild-type SARS-CoV-2. Columns A-F: 50 nM SARS-CoV-2. Columns G and H: 10 nM SARS-CoV-2. Column I: 2 nM SARS-CoV-2. Blank cells: data not available.

Table 1-2 shows the results of a live cell assay described above demonstrating which exemplary anti-coronavirus antibodies bind to wild-type SARS-CoV-2. Columns A-E: 50 nM SARS-CoV-2. Column F and G: 10 nM SARS-CoV-2. Column H: 2 nM SARS-CoV-2. Blank cells: data not available.

Table 1-3 shows the results of a live cell assay described above demonstrating which exemplary anti-coronavirus antibodies bind to wild-type SARS-CoV-2. Columns A-E: 50 nM SARS-CoV-2 V483A mutant. Column F: 50 nM SARS-CoV-2 V367F mutant. Column G: 50 nM SARS-CoV-2 D641G mutant. Blank cells: data not available.

Table 1-4 shows the results of a bead assay described above demonstrating which exemplary anti-coronavirus antibodies cross-react with SARS. Columns A-E: 50 nM SARS. Columns F and G: 10 nM SARS. Column H: 2 nM SARS. Blank cells: data not available.

Table 1-5 shows the results of a bead assay described above demonstrating which exemplary anti-coronavirus antibodies cross-react with WIV1. Columns A-E: 50 nM WIV1. Columns F and G: 10 nM WIV1. Column H: 2 nM WIV1. Blank cells: data not available.

Table 1-6 shows the results of a bead assay described above demonstrating which exemplary anti-coronavirus antibodies bind to particular SARS-CoV-2 proteins and Spike variants. Column A: 50 nM SARS-CoV-2. Column B: 50 nM SARS-CoV-2 NTD. Column C: 50 nM SARS-CoV-2 RBD. Column D: 50 nM SARS-CoV-2 S1 D614G. Column E: 50 nM SARS-CoV-2 S1. Column F: 50 nM SARS-CoV-2 D614G. Column G: 50 nM SARS-CoV-2 N439K. Column H: 50 nM SARS-CoV-2 S494P. Column I: 50 nM SARS-CoV-2 F490S. Column J: 50 nM SARS-CoV-2 A222V. Column K: 50 nM SARS-CoV-2 S50L. Column L: 50 nM SARS-CoV-2 B.1.351. Column M: 50 nM SARS-CoV-2 B.1.1.7.

Table 1-7 shows the results of a bead assay described above demonstrating which exemplary anti-coronavirus antibodies bind to other coronavirus proteins. Column A: 50 nM HKU. Column B: 50 nM MERS. Column C: 50 nM SARS-1. Column D: 50 nM WIV-1. Column E: 50 nM negative control.

Table 1-8 shows the results of a live cell assay described above demonstrating which exemplary anti-coronavirus antibodies bind to particular cells expressing particular SARS-CoV-2 NTD variants. Column A: 50 nM R21I cells. Column B: 50 nM T22I cells. Column C: 50 nM T29I cells. Column D: 50 nM H49Y cells. Column E: 50 nM S50L cells. Column F: 50 nM D138H cells. Column G: 50 nM S254F cells.

Table 1-9 shows the results of a live cell assay described above demonstrating which exemplary anti-coronavirus antibodies bind to particular cells expressing particular SARS-CoV-2 RBD variants. Column A: 50 nM V367F cells. Column B: 50 nM Q409E cells. Column C: 50 nM N439K cells. Column D: 50 nM G476S cells. Column E: 50 nM S477N cells. Column F: 50 nM T478I cells. Column G: 50 nM V483A cells. Column H: 50 nM F490S cells. Column I: 50 nM S494P cells. Column J: 50 nM N501Y cells. Column K: 50 nM G504D cells. Column L: 50 nM A520S cells.

Table 1-10 shows the results of a live cell assay described above demonstrating which exemplary anti-coronavirus antibodies bind to particular cells expressing coronavirus proteins. Column A: 50 nM SARS-CoV-2 cells. Column B: 50 nM SARS-CoV-2 D614G cells. Column C: 50 nM SARS-CoV-2 B.1.1.7 cells. Column D: 50 nM SARS-CoV-2 B.1.351 cells. Column E: 50 nM SARS-CoV cells. Column F: Negative control cells.

TABLE 1-1

Binding to Wild-Type SARS-CoV-2 (Bead Assay)

| Antibody ID | A | B | C | D | E | F | G | H | I |
|---|---|---|---|---|---|---|---|---|---|
| 258 | | 654.17 | | 282.10 | | | | 336.60 | |
| 259 | | | | 274.62 | | | | | |
| 260 | | | | 724.13 | | | | | |
| 261 | 542.68 | 997.13 | | 619.94 | | | 160.26 | 444.66 | 47.44 |
| 262 | | 372.32 | | 64.07 | | | | 20.60 | |
| 263 | | | | 722.50 | | | | | |
| 264 | | | | 597.90 | | | | | |
| 265 | | | | 1283.39 | | | | | |
| 266 | | | | 472.98 | | | | | |
| 267 | | | | 312.20 | | | | | |
| 268 | 297.76 | 0.99 | | 513.25 | | | 111.48 | 0.98 | 30.29 |
| 269 | | 480.28 | | 191.05 | | | | 188.11 | |
| 270 | | | | 304.73 | | | | | |
| 271 | | | | 448.53 | | | | | |
| 272 | | 1352.02 | | 678.91 | | | | 852.12 | |
| 273 | 923.69 | | | | | | | | |
| 274 | | 943.76 | | 127.21 | 1.18 | | | 392.61 | |
| 275 | 345.95 | 665.27 | | 437.69 | | | 180.61 | 348.03 | 74.79 |
| 276 | | | | 747.77 | | | | | |
| 277 | 548.05 | 867.71 | | 506.71 | | | 320.53 | 482.79 | 121.04 |
| 278 | 119.65 | 556.13 | | 321.43 | | | 14.80 | 184.75 | 3.29 |
| 279 | | 3.09 | | 1.36 | | | | 1.11 | |
| 280 | 219.33 | 615.18 | | 293.51 | | | 111.79 | 374.85 | 42.46 |
| 281 | | | | 570.04 | | | | | |
| 283 | | 232.15 | | 250.46 | | | | 57.46 | |
| 284 | | | | 714.03 | | | | | |
| 285 | 265.30 | 542.28 | | 405.29 | | | 74.32 | 222.19 | 14.36 |
| 286 | 227.89 | 228.10 | | 312.20 | | | 64.27 | 48.44 | 9.93 |
| 287 | 711.63 | 1017.56 | | 573.05 | | | 473.50 | 548.16 | 205.64 |
| 288 | | | | 495.15 | | | | | |
| 290 | | | | 1.16 | | | | | |
| 291 | | 757.28 | | 381.70 | | | | 413.53 | |
| 292 | 1010.17 | 1494.67 | 969.44 | 921.34 | 972.31 | | 699.57 | 1093.49 | 419.66 |
| 294 | | | | 1232.58 | | | | | |
| 295 | | | | 598.78 | | | | | |
| 296 | | 1.09 | | 1.15 | | | | 1.08 | |
| 297 | | 925.83 | | 513.34 | | | | 596.03 | |
| 298 | | 1385.48 | | 748.89 | | | | 842.30 | |
| 299 | | | | 1.43 | | | | | |
| 300 | | | | 721.20 | | | | | |
| 301 | | | | 865.03 | | | | | |
| 302 | 532.02 | 920.84 | | 571.43 | | | 133.45 | 387.79 | 17.39 |
| 303 | | | | 340.89 | | | | | |
| 304 | | 1.22 | | 1.17 | | | | 1.09 | |
| 305 | | 470.00 | | 448.76 | | | | 130.16 | |
| 306 | | | | 338.09 | | | | | |
| 307 | | 1188.27 | | 753.87 | | | | 572.61 | |
| 308 | | 757.76 | | 346.18 | | | | 398.14 | |
| 309 | 557.73 | 856.65 | 558.04 | 473.88 | 578.48 | | 344.16 | 518.05 | 146.21 |
| 310 | | 250.07 | | 151.80 | | | | 83.28 | |
| 311 | | 1014.32 | | 527.12 | | | | 506.43 | |
| 312 | | 717.25 | | 370.51 | | | | 244.35 | |
| 313 | | 656.13 | | 344.72 | | | | 328.21 | |
| 314 | | 1086.51 | | 657.54 | | | | 424.26 | |
| 315 | | | | 592.29 | | | | | |
| 316 | | | | 441.70 | | | | | |
| 317 | | | | 890.13 | | | | | |
| 318 | | 839.38 | | 409.72 | | | | 528.53 | |
| 319 | | | | 434.71 | | | | | |
| 320 | | | | 1203.87 | | | | | |
| 321 | | 253.61 | | 59.23 | | | | 55.51 | |
| 322 | | 110.56 | | 312.59 | | | | 8.84 | |

TABLE 1-1-continued

| | Binding to Wild-Type SARS-CoV-2 (Bead Assay) | | | | | | | | |
|---|---|---|---|---|---|---|---|---|---|
| Antibody ID | A | B | C | D | E | F | G | H | I |
| 323 | | | | 994.30 | | | | | |
| 324 | | | | 1.13 | | | | | |
| 325 | | 455.25 | | 135.46 | | | | 140.57 | |
| 326 | | | | 192.92 | | | | | |
| 327 | | | | 413.06 | | | | | |
| 328 | | | | 1.20 | | | | | |
| 329 | | | | 496.63 | | | | | |
| 330 | | 366.17 | | 312.31 | | | | 70.57 | |
| 331 | | | | 850.47 | | | | | |
| 332 | | | | 1.22 | | | | | |
| 333 | | | | 1.08 | | | | | |
| 334 | | 294.16 | | 136.76 | | | | 98.63 | |
| 335 | 1.06 | 1.08 | | 77.65 | 38.96 | 105.22 | 1.19 | 0.93 | 0.99 |
| 335 | | | | 105.22 | | | | | |
| 336 | | 679.19 | | 406.31 | | | | 117.98 | |
| 337 | | | | 756.03 | | | | | |
| 338 | | 562.82 | | 155.20 | | | | 206.77 | |
| 339 | | | | 873.86 | | | | | |
| 340 | | | | 546.84 | | | | | |
| 341 | 1.29 | 1.22 | | 1.17 | | | 1.19 | 1.00 | 1.09 |
| 342 | | | | 745.63 | | | | | |
| 343 | | | | 1.20 | | | | | |
| 344 | | | | 403.95 | | | | | |
| 345 | | | | 561.95 | | | | | |
| 346 | 274.63 | 358.12 | | 193.49 | | | 90.67 | 98.99 | 19.23 |
| 347 | | | | 598.50 | | | | | |
| 348 | | | | 869.29 | | | | | |
| 349 | | | | 118.34 | | | | | |
| 350 | 1288.69 | | | 812.79 | | | | 938.17 | |
| 351 | | | | 1.06 | | | | | |
| 352 | | 1211.33 | | 396.07 | | | | 364.14 | |
| 353 | 596.85 | 945.10 | | 578.48 | | | 441.27 | 605.76 | 234.76 |
| 354 | 2.03 | 95.02 | | 8.56 | | | 1.17 | 16.26 | 1.06 |
| 355 | | 708.91 | | 514.32 | | | | 309.09 | |
| 356 | 754.87 | 1083.64 | | 637.29 | | | 499.03 | 608.86 | 198.83 |
| 357 | | 262.21 | | 248.50 | | | | 82.13 | |
| 358 | 282.03 | 415.72 | | 345.87 | | | 71.19 | 147.18 | 14.26 |
| 359 | 389.89 | 681.77 | | 326.29 | | | 172.29 | 336.71 | 74.66 |
| 360 | 178.08 | 341.26 | | 268.03 | | | 57.69 | 116.28 | 16.60 |
| 361 | | 618.28 | | 207.68 | | | | 217.28 | |
| 362 | | | | 503.30 | | | | | |
| 363 | | | | 1032.16 | | | | | |
| 364 | 250.11 | 94.54 | 155.45 | 714.43 | 567.82 | | 57.20 | 18.17 | 19.03 |
| 365 | | | | 532.61 | | | | | |
| 366 | | | | 552.94 | | | | | |
| 367 | | | | 1093.21 | | | | | |
| 368 | | 987.26 | | 472.10 | | | | 544.93 | |
| 369 | 359.05 | 648.54 | | 327.14 | | | 194.80 | 323.95 | 82.65 |
| 370 | 992.98 | | | 467.27 | | | | 570.72 | |
| 371 | 555.38 | | | 386.49 | | | | 226.34 | |
| 372 | | | | 822.92 | | | | | |
| 373 | 367.94 | 1062.17 | 709.69 | 754.81 | 866.40 | | 176.12 | 617.72 | 111.39 |
| 374 | 100.62 | 104.26 | | 90.13 | | | 24.41 | 24.06 | 5.54 |
| 375 | | | | 287.29 | | | | | |
| 377 | | 1.05 | | 0.86 | | | | | 1.01 |
| 378 | | | | 525.80 | | | | | |
| 379 | | | | 648.43 | | | | | |
| 380 | | | | 1.15 | | | | | |
| 381 | 349.53 | 806.74 | | 495.13 | | | 190.64 | 368.50 | 69.68 |
| 382 | 0.93 | 1.05 | | 1.07 | | | 0.95 | 1.07 | 0.80 |
| 383 | 308.53 | 691.74 | | 310.52 | | | 126.22 | 277.71 | 34.36 |
| 384 | 423.68 | 875.57 | | 567.48 | | | 290.88 | 560.26 | 140.75 |
| 385 | | | | 601.75 | | | | | |
| 386 | 1.05 | 1.04 | | 446.12 | 464.11 | | 1.15 | 1.03 | 0.84 |
| 387 | | 598.74 | | 316.10 | | | | 220.09 | |
| 388 | 456.60 | 924.88 | 627.20 | 496.15 | 596.86 | | 298.68 | 623.40 | 188.99 |
| 389 | | 355.21 | | 205.18 | | | | 98.57 | |
| 390 | | 636.70 | | 341.28 | | | | 317.60 | |
| 391 | | 615.70 | | 142.50 | | | | 160.54 | |
| 392 | 509.20 | | | | | | | | |
| 393 | 263.50 | 704.89 | | 397.18 | | | 118.09 | 335.73 | 40.96 |
| 394 | | 1340.33 | | 752.37 | | | | 832.36 | |
| 395 | | | | 591.97 | | | | | |
| 396 | | | | 553.32 | | | | | |
| 397 | | 407.53 | | 231.47 | | | | 122.95 | |

TABLE 1-1-continued

| Binding to Wild-Type SARS-CoV-2 (Bead Assay) | | | | | | | | | |
|---|---|---|---|---|---|---|---|---|---|
| Antibody ID | A | B | C | D | E | F | G | H | I |
| 398 | | | | 648.01 | | | | | |
| 399 | | 556.95 | | 171.02 | | | | 157.94 | |
| 400 | | 1202.88 | | 748.10 | | | | 510.98 | |
| 401 | | 418.06 | | 201.06 | | | | 186.92 | |
| 402 | 485.92 | 1356.49 | | 701.68 | | | 327.63 | 936.11 | 171.64 |
| 403 | 257.07 | 762.96 | | 302.07 | | | 87.60 | 353.99 | 24.44 |
| 404 | | 363.12 | | 198.49 | | | | 115.92 | |
| 405 | | | | 486.64 | | | | | |
| 407 | | | | 784.82 | | | | | |
| 408 | 601.28 | 1196.34 | 847.10 | 861.47 | 998.68 | | 267.62 | 497.99 | 95.29 |
| 409 | | | | 552.36 | | | | | |
| 410 | 141.97 | 592.17 | | 249.30 | | | 23.40 | 178.63 | 2.66 |
| 411 | 0.78 | 1.05 | | 576.30 | 747.57 | | 0.81 | 1.03 | 0.82 |
| 412 | | | | 689.58 | | | | | |
| 413 | | 969.16 | | 366.69 | | | | 416.00 | |
| 414 | 374.45 | 658.47 | 567.00 | 667.48 | 610.89 | | 203.16 | 443.30 | 92.27 |
| 415 | 409.68 | 962.17 | | 434.95 | | | 261.42 | 539.48 | 127.87 |
| 416 | | | | 110.41 | | | | | |
| 417 | 421.91 | 961.35 | 589.51 | 460.10 | 578.51 | | 234.88 | 506.90 | 101.29 |
| 418 | | | | 753.99 | | | | | |
| 419 | | 1941.02 | 1016.73 | 768.38 | 1016.40 | | | 1171.12 | |
| 420 | | 149.82 | | 189.44 | | | | 25.22 | |
| 421 | | | | 505.29 | | | | | |
| 422 | | | | 1249.68 | | | | | |
| 423 | | | | 1186.89 | | | | | |
| 426 | 0.79 | 1.04 | | 550.97 | 555.80 | | 0.82 | 0.98 | 0.92 |
| 427 | | | | 494.44 | | | | | |
| 428 | 145.80 | 342.30 | | 128.38 | | | 40.41 | 92.27 | 7.50 |
| 429 | 502.90 | 1086.89 | | 598.82 | | | 382.83 | 697.73 | 244.98 |
| 430 | 120.41 | 101.30 | | 293.74 | | | 14.63 | 10.33 | 1.97 |
| 431 | | | | 714.53 | | | | | |
| 432 | 0.97 | 0.72 | | 0.96 | | | 1.02 | 0.88 | 0.90 |
| 433 | | 1325.24 | | 393.10 | | | | 493.87 | |
| 434 | | | | 1.33 | | | | | |
| 435 | | | | 605.81 | | | | | |
| 436 | 7.84 | 39.28 | | 11.70 | | | 1.15 | 2.00 | 1.04 |
| 437 | | | | 591.26 | | | | | |
| 438 | 457.94 | 1135.88 | | 758.99 | | | 215.69 | 472.36 | 68.86 |
| 439 | | | | 226.66 | | | | | |
| 440 | | 693.42 | | 350.78 | | | | 88.25 | |
| 441 | | 52.86 | | 129.79 | | | | 1.31 | |
| 442 | 415.35 | 961.18 | 528.51 | 427.47 | 501.23 | | 266.41 | 518.68 | 119.97 |
| 443 | | | | 1.06 | | | | | |
| 444 | | 0.97 | | 0.91 | | | | 0.90 | |
| 445 | | 1554.93 | 805.30 | 668.49 | 839.72 | | | 771.63 | |
| 446 | | | | 435.44 | | | | | |
| 447 | | 1690.11 | 1010.32 | 1018.92 | 1127.60 | | | 1413.52 | |
| 448 | | 779.34 | | 371.76 | | | | 229.43 | |
| 449 | | 678.26 | | 441.01 | | | | 195.25 | |
| 450 | | 1.30 | | 0.89 | | | | 1.11 | |
| 451 | | 395.86 | | 197.42 | | | | 129.42 | |
| 452 | | | | 853.50 | | | | | |
| 453 | 263.82 | 587.52 | | 418.12 | 532.22 | | 131.98 | 252.17 | 46.46 |
| 454 | | | | 1094.42 | | | | | |
| 455 | | 533.89 | | 333.27 | | | | 175.30 | |
| 456 | | | | 595.49 | | | | | |
| 457 | 1.04 | 1.28 | | 564.89 | 631.84 | | 0.98 | 1.03 | 0.93 |
| 458 | | 218.68 | | 318.89 | | | | 56.46 | |
| 459 | 459.63 | 911.52 | | 494.38 | | | 298.31 | 483.23 | 132.85 |
| 460 | | 732.42 | | 422.97 | | | | 458.44 | |
| 461 | | 1762.41 | | 762.70 | | | | 1006.02 | |
| 462 | | 1215.76 | 596.85 | 719.50 | 728.93 | | | 720.21 | |
| 463 | | 918.84 | | 447.44 | | | | 570.90 | |
| 464 | | 1.27 | | 0.99 | | | | 1.04 | |
| 465 | | 1164.65 | | 171.45 | | | | 359.00 | |
| 466 | 0.94 | 1.12 | | 679.43 | 836.59 | | 0.88 | 1.01 | 0.78 |
| 467 | | 724.17 | | 378.10 | | | | 214.72 | |
| 468 | | 1892.20 | | 818.27 | | | | 1154.67 | |
| 469 | | 729.88 | | 240.83 | | | | 125.22 | |
| 470 | | | | 1178.02 | | | | | |
| 471 | | | | 770.02 | | | | | |
| 472 | | 98.26 | | | | | | 57.38 | 22.33 |
| 473 | 283.41 | 656.91 | | 493.49 | | | 122.90 | 488.36 | 45.27 |
| 474 | | | | 1.47 | | | | | |
| 475 | | | | 682.90 | | | | | |

TABLE 1-1-continued

| Binding to Wild-Type SARS-CoV-2 (Bead Assay) | | | | | | | | | |
|---|---|---|---|---|---|---|---|---|---|
| Antibody ID | A | B | C | D | E | F | G | H | I |
| 476 | | | | 901.67 | | | | | |
| 477 | | | | 846.89 | | | | | |
| 478 | 425.63 | 801.68 | | 500.81 | | | 266.86 | 406.41 | 117.86 |
| 479 | | 930.19 | 583.15 | 479.93 | 631.87 | | | 568.45 | |
| 480 | | | | 689.79 | | | | | |
| 481 | | 1421.56 | 859.59 | 872.99 | 932.50 | | | 986.47 | |
| 482 | | 871.96 | | 587.30 | | | | 369.20 | |
| 483 | | 970.31 | 662.14 | 417.38 | 627.17 | | | 572.28 | |
| 484 | 377.79 | 736.80 | | 487.79 | | | 195.35 | 324.87 | 72.89 |
| 485 | | | | 509.90 | | | | | |
| 486 | 339.44 | 725.73 | | 461.05 | | | 195.81 | 375.98 | 83.03 |
| 487 | | | | 661.24 | | | | | |
| 488 | 727.67 | 1441.72 | 903.25 | 848.16 | 982.36 | | 431.29 | 751.45 | 157.90 |
| 489 | | 832.67 | | 460.46 | | | | 483.69 | |
| 490 | | 1.04 | | 285.49 | 409.18 | | | 1.10 | |
| 491 | 422.62 | 864.59 | | 492.61 | 598.95 | | 262.46 | 435.65 | 104.91 |
| 492 | | | | 663.54 | | | | | |
| 493 | | 1009.77 | | 334.97 | | | | 381.21 | |
| 494 | | 921.31 | 680.18 | 614.14 | 721.68 | | | 409.53 | |
| 495 | | 1085.27 | | 383.85 | | | | 530.14 | |
| 496 | | | | 1086.41 | | | | | |
| 497 | | | | 629.60 | | | | | |
| 498 | | | | 497.11 | | | | | |
| 499 | | 1122.21 | | 386.00 | | | | 431.73 | |
| 500 | 318.49 | 630.75 | | 481.37 | | | 182.05 | 291.84 | 70.75 |
| 501 | | 1638.91 | | 769.93 | | | | 507.57 | |
| 502 | 550.86 | 1144.38 | | 681.93 | | | 282.78 | 554.06 | 87.31 |
| 503 | | 151.56 | | 790.27 | | | | 8.59 | |
| 504 | | | | 708.99 | | | | | |
| 505 | | | | 657.81 | | | | | |
| 506 | 2283.31 | 1111.78 | | 823.97 | 1028.39 | | | 1197.23 | |
| 507 | | | | 571.25 | | | | | |
| 508 | 120.54 | 401.03 | | 123.83 | | | 19.72 | 147.75 | 3.09 |
| 509 | | | | 496.12 | | | | | |
| 510 | | | | 0.95 | | | | | |
| 511 | | 835.54 | | 327.79 | | | | 303.14 | |
| 512 | | | | 547.64 | | | | | |
| 513 | | 691.44 | | 307.73 | | | | 224.48 | |
| 514 | | | | 1.60 | | | | | |
| 515 | | 1461.98 | | 691.55 | | | | 736.01 | |
| 516 | | | | 1.48 | | | | | |
| 517 | | | | 433.64 | | | | | |
| 518 | 371.72 | 782.60 | | 443.17 | | | 171.94 | 400.93 | 71.95 |
| 519 | 56.56 | 122.97 | | 74.58 | | | 4.04 | 26.55 | 1.13 |
| 520 | | 461.48 | | 201.34 | | | | 126.55 | |
| 521 | | 49.21 | | 34.05 | | | | 2.06 | |
| 522 | | | | 433.00 | | | | | |
| 523 | | | | 30.76 | | | | | |
| 524 | | 1.51 | | 1.24 | | | | 1.08 | |
| 525 | | 533.28 | | 419.16 | | | | 180.43 | |
| 526 | 197.27 | 524.47 | | 138.20 | | | 31.28 | 114.67 | 5.21 |
| 527 | | | | 148.09 | | | | | |
| 528 | 105.01 | 123.50 | | 308.96 | | | 14.03 | 285.35 | 2.44 |
| 529 | 1.06 | 1.34 | | 12.21 | | | 0.92 | 22.74 | 0.80 |
| 530 | 150.10 | 295.90 | | 151.58 | | | 54.36 | 149.84 | 11.72 |
| 531 | | | | 380.55 | | | | | |
| 532 | 817.45 | 1566.59 | | 999.97 | | | 663.17 | 1052.24 | 368.40 |
| 533 | | | | 23.40 | | | | | |
| 534 | | 695.90 | | 218.50 | | | | 404.28 | |
| 535 | | 1425.49 | | 948.76 | | | | 1098.37 | |
| 536 | | | | 643.45 | | | | | |
| 537 | | | | 786.79 | | | | | |
| 538 | | | | 607.35 | | | | | |
| 539 | | 1951.09 | 983.89 | 799.27 | 990.16 | | | 1179.41 | |
| 540 | | 769.66 | 470.19 | 345.97 | 485.40 | | | 310.25 | |
| 541 | | | | 1.24 | | | | | |
| 542 | | | | 597.71 | | | | | |
| 543 | | | | 802.50 | | | | | |
| 544 | | | | 639.22 | | | | | |
| 545 | | | | 938.88 | | | | | |
| 546 | | | | 1161.05 | | | | | |
| 547 | | | | 605.82 | | | | | |
| 548 | | | | 642.50 | | | | | |
| 549 | | 1350.94 | 901.67 | 1.04 | 1.15 | | | 656.49 | |
| 550 | | | | 1.53 | | | | | |

TABLE 1-1-continued

Binding to Wild-Type SARS-CoV-2 (Bead Assay)

| Antibody ID | A | B | C | D | E | F | G | H | I |
|---|---|---|---|---|---|---|---|---|---|
| 551 | | | | 649.34 | | | | | |
| 552 | | 1197.75 | 607.47 | 517.18 | 660.30 | | | 483.39 | |
| 553 | | 412.96 | 306.84 | 457.47 | 546.27 | | | 110.66 | |
| 554 | | 821.54 | | 437.86 | | | | 364.56 | |
| 555 | | 1852.09 | 605.08 | 1113.30 | 1233.03 | | | 1379.32 | |
| 556 | | | | 625.23 | | | | | |
| 557 | | 765.62 | | 538.53 | | | | 362.93 | |
| 558 | | 964.14 | | 373.03 | | | | 410.26 | |
| 559 | | 1183.02 | | 0.97 | 1.15 | | | 477.48 | |
| 560 | | | | 991.42 | | | | | |
| 561 | | 788.14 | | 572.82 | | | | 421.78 | |
| 562 | | 742.77 | 466.07 | 402.17 | 491.67 | | | 365.23 | |
| 563 | | | | 512.96 | | | | | |
| 564 | | | | 522.61 | | | | | |
| 565 | | 1.29 | | 0.97 | | | | 1.11 | |
| 566 | | | | 613.29 | | | | | |
| 567 | | 233.98 | | 153.96 | | | | 68.44 | |
| 568 | | 156.72 | | 53.37 | | | | 25.21 | |
| 569 | | | | 478.07 | | | | | |
| 570 | | 355.29 | | 188.82 | | | | 130.30 | |
| 571 | | | | 337.90 | | | | | |
| 572 | | 0.98 | | 471.28 | 567.62 | | | 1.07 | |
| 573 | | 0.96 | | 295.02 | 256.90 | | | 0.94 | |
| 574 | | 227.18 | | 172.40 | | | | 68.46 | |
| 575 | | 831.67 | | 562.18 | | | | 331.22 | |
| 576 | | | | 565.54 | | | | | |
| 577 | | 0.93 | | 1.06 | | | | 0.94 | |
| 579 | | 8.84 | | 34.80 | | | | 1.69 | |
| 580 | | | | 771.66 | | | | | |
| 581 | | | | 0.99 | | | | | |
| 582 | | | | 676.11 | | | | | |
| 583 | | | | 717.61 | | | | | |
| 584 | | 155.46 | | 66.16 | | | | 8.93 | |
| 585 | | 650.62 | | 311.18 | | | | 349.37 | |
| 586 | | | | 1.18 | | | | | |
| 587 | | 77.27 | | 1.31 | | | | 12.82 | |
| 588 | | | | 1.46 | | | | | |

TABLE 1-2

Binding to Wild-Type SARS-CoV-2 (Live Cell Assay)

| Antibody ID | A | B | C | D | E | F | G | H |
|---|---|---|---|---|---|---|---|---|
| 258 | | 11.99 | | | | | 9.66 | |
| 259 | | | | 2.58 | | | | |
| 260 | | | | 10.26 | | | | |
| 261 | 42.06 | 31.24 | | | | 28.40 | 21.75 | 10.65 |
| 262 | | 1.49 | | | | | 0.89 | |
| 263 | | | | 22.48 | | | | |
| 264 | | | | 10.26 | | | | |
| 265 | | | | 21.45 | | | | |
| 266 | | | | 10.28 | | | | |
| 267 | | | | 2.81 | | | | |
| 268 | 12.60 | 1.13 | | | | 7.83 | 0.98 | 4.75 |
| 269 | | 13.32 | | | | | 9.09 | |
| 270 | | | | 1.87 | | | | |
| 271 | | | | 7.98 | | | | |
| 272 | | 24.07 | | | | | 14.42 | |
| 273 | | | | 16.95 | | | | |
| 274 | | 21.26 | | 1.55 | | | 12.33 | |
| 275 | 11.71 | 8.94 | | | | 8.65 | 6.23 | 6.29 |
| 276 | | | | 9.24 | | | | |
| 277 | 12.15 | 10.20 | | | | 10.21 | 8.09 | 8.64 |
| 278 | 25.82 | 27.27 | | | | 18.90 | 16.52 | 7.17 |
| 279 | | 8.59 | | | | | 3.84 | |
| 280 | 33.46 | 25.01 | | | | 26.29 | 18.55 | 15.29 |
| 281 | | | | 24.33 | | | | |
| 283 | | 9.63 | | | | | 7.62 | |
| 284 | | | | 30.25 | | | | |
| 285 | 36.19 | 31.07 | | | | 26.21 | 20.43 | 16.70 |
| 286 | 12.38 | 8.02 | | | | 10.10 | 4.90 | 8.86 |

TABLE 1-2-continued

| Binding to Wild-Type SARS-CoV-2 (Live Cell Assay) | | | | | | | | |
|---|---|---|---|---|---|---|---|---|
| Antibody ID | A | B | C | D | E | F | G | H |
| 287 | 38.18 | 30.60 | | | | 29.26 | 21.95 | 12.75 |
| 288 | | | | 24.27 | | | | |
| 290 | | | | 0.98 | | | | |
| 291 | | 16.68 | | | | | 15.08 | |
| 292 | 23.77 | 16.28 | 17.03 | 18.57 | | 19.75 | 14.73 | 10.99 |
| 294 | | | | 22.24 | | | | |
| 295 | | | | 9.67 | | | | |
| 296 | | 1.06 | | | | | 1.12 | |
| 297 | | 11.72 | | | | | 10.67 | |
| 298 | | 23.17 | | | | | 17.94 | |
| 299 | | | | 2.11 | | | | |
| 300 | | | | 9.71 | | | | |
| 301 | | | | 29.71 | | | | |
| 302 | 46.22 | 31.31 | | | | 17.25 | 8.93 | 5.13 |
| 303 | | | | 9.59 | | | | |
| 304 | | 1.09 | | | | | 1.12 | |
| 305 | | 27.18 | | | | | 15.62 | |
| 306 | | | | 2.57 | | | | |
| 307 | | 11.40 | | | | | 5.38 | |
| 308 | | 17.66 | | | | | 15.99 | |
| 309 | 11.93 | 9.67 | 8.52 | 9.04 | | 10.55 | 8.16 | 7.92 |
| 310 | | 12.34 | | | | | 9.68 | |
| 311 | | 18.34 | | | | | 10.39 | |
| 312 | | 9.75 | | | | | 3.94 | |
| 313 | | 9.31 | | | | | 7.31 | |
| 314 | | 13.00 | | | | | 3.95 | |
| 315 | | | | 8.85 | | | | |
| 316 | | | | 10.68 | | | | |
| 317 | | | | 11.23 | | | | |
| 318 | | 22.75 | | | | | 17.94 | |
| 319 | | | | 10.40 | | | | |
| 320 | | | | 20.66 | | | | |
| 321 | | 7.38 | | | | | 2.54 | |
| 322 | | 4.94 | | | | | 1.65 | |
| 323 | | | | 20.62 | | | | |
| 324 | | | | 9.44 | | | | |
| 325 | | 1.14 | | | | | 1.08 | |
| 326 | | | | 10.11 | | | | |
| 327 | | | | 9.54 | | | | |
| 328 | | | | 1.60 | | | | |
| 329 | | | | 9.41 | | | | |
| 330 | | 20.60 | | | | | 12.08 | |
| 331 | | | | 20.08 | | | | |
| 332 | | | | 1.75 | | | | |
| 333 | | | | 1.27 | | | | |
| 334 | | 7.68 | | | | | 5.56 | |
| 335 | 1.28 | 0.97 | | 6.41 | 7.43 | 1.26 | 0.98 | 1.24 |
| 335 | | | | 7.43 | | | | |
| 336 | | 18.45 | | | | | 5.57 | |
| 337 | | | | 2.08 | | | | |
| 338 | | 9.48 | | | | | 7.51 | |
| 339 | | | | 21.25 | | | | |
| 340 | | | | 33.17 | | | | |
| 341 | 1.20 | 1.04 | | | | 1.15 | 0.98 | 1.17 |
| 342 | | | | 4.69 | | | | |
| 343 | | | | 1.12 | | | | |
| 344 | | | | 7.55 | | | | |
| 345 | | | | 11.71 | | | | |
| 346 | 6.41 | 4.41 | | | | 2.55 | 1.66 | 1.53 |
| 347 | | | | 7.81 | | | | |
| 348 | | | | 19.61 | | | | |
| 349 | | | | 1.43 | | | | |
| 350 | | 53.42 | | | | | 46.10 | |
| 351 | | | | 1.06 | | | | |
| 352 | | 18.45 | | | | | 3.63 | |
| 353 | 16.51 | 12.15 | | | | 12.17 | 8.68 | 10.36 |
| 354 | 9.83 | 7.81 | | | | 6.61 | 4.70 | 3.87 |
| 355 | | 7.00 | | | | | 1.75 | |
| 356 | 42.33 | 31.24 | | | | 29.98 | 22.58 | 12.63 |
| 357 | | 7.08 | | | | | 5.26 | |
| 358 | 13.57 | 10.65 | | | | 10.75 | 8.15 | 8.99 |
| 359 | 11.79 | 9.74 | | | | 9.95 | 7.43 | 6.54 |
| 360 | 10.31 | 7.78 | | | | 6.94 | 4.91 | 3.72 |
| 361 | | 9.35 | | | | | 7.51 | |
| 362 | | | | 9.45 | | | | |
| 363 | | | | 16.75 | | | | |

TABLE 1-2-continued

Binding to Wild-Type SARS-CoV-2 (Live Cell Assay)

| Antibody ID | A | B | C | D | E | F | G | H |
|---|---|---|---|---|---|---|---|---|
| 364 | 30.75 | 6.57 | 19.95 | 26.68 | | 19.82 | 1.96 | 7.22 |
| 365 | | | | 10.70 | | | | |
| 366 | | | | 8.97 | | | | |
| 367 | | | | 26.48 | | | | |
| 368 | | 22.03 | | | | | 15.87 | |
| 369 | 11.08 | 8.80 | | | | 8.86 | 6.37 | 5.56 |
| 370 | | 12.33 | | | | | 9.66 | |
| 371 | | 1.30 | | | | | 0.97 | |
| 372 | | | | 30.17 | | | | |
| 373 | 62.79 | 27.08 | 19.81 | 18.43 | | 34.64 | 15.12 | 16.55 |
| 374 | 2.59 | 1.19 | | | | 1.67 | 0.85 | 1.62 |
| 375 | | | | 5.57 | | | | |
| 377 | | 0.83 | | | | | 0.78 | |
| 378 | | | | 25.34 | | | | |
| 379 | | | | 1.63 | | | | |
| 380 | | | | 1.06 | | | | |
| 381 | 50.53 | 24.54 | | | | 35.01 | 10.81 | 14.16 |
| 382 | 1.20 | 0.78 | | | | 1.20 | 0.69 | 1.27 |
| 383 | 3.83 | 1.61 | | | | 1.88 | 1.00 | 1.52 |
| 384 | 22.52 | 10.96 | | | | 16.83 | 7.96 | 14.30 |
| 385 | | | | 10.46 | | | | |
| 386 | 1.26 | 0.81 | | 8.70 | | 1.15 | 0.71 | 1.13 |
| 387 | | 6.22 | | | | | 2.13 | |
| 388 | 30.71 | 12.40 | 9.24 | 9.33 | | 19.36 | 8.74 | 17.36 |
| 389 | | 1.13 | | | | | 0.72 | |
| 390 | | 0.96 | | | | | 0.73 | |
| 391 | | 9.53 | | | | | 2.91 | |
| 392 | | | | 1.30 | | | | |
| 393 | 24.09 | 10.95 | | | | 16.29 | 7.55 | 10.45 |
| 394 | | 22.14 | | | | | 15.91 | |
| 395 | | | | 7.80 | | | | |
| 396 | | | | 3.58 | | | | |
| 397 | | 8.87 | | | | | 5.24 | |
| 398 | | | | 8.33 | | | | |
| 399 | | 20.67 | | | | | 9.23 | |
| 400 | | 22.67 | | | | | 10.64 | |
| 401 | | 8.35 | | | | | 7.68 | |
| 402 | 44.67 | 24.74 | | | | 36.54 | 17.12 | 20.05 |
| 403 | 21.33 | 9.50 | | | | 15.66 | 7.34 | 10.23 |
| 404 | | 7.20 | | | | | 5.05 | |
| 405 | | | | 9.70 | | | | |
| 407 | | | | 2.66 | | | | |
| 408 | 34.15 | 12.70 | 9.22 | 12.09 | | 11.01 | 3.45 | 4.17 |
| 409 | | | | 13.84 | | | | |
| 410 | 9.01 | 5.00 | | | | 2.75 | 1.33 | 1.66 |
| 411 | 1.49 | 0.77 | | 9.87 | | 1.34 | 0.66 | 1.37 |
| 412 | | | | 22.64 | | | | |
| 413 | | 1.31 | | | | | 1.11 | |
| 414 | 52.46 | 11.67 | 29.15 | 26.17 | | 49.60 | 15.52 | 29.37 |
| 415 | 26.51 | 8.21 | | | | 18.91 | 8.01 | 16.32 |
| 416 | | | | 1.58 | | | | |
| 417 | 6.14 | 2.15 | 2.43 | 1.91 | | 3.64 | 1.45 | 2.89 |
| 418 | | | | 10.87 | | | | |
| 419 | | 22.69 | 25.75 | 24.97 | | | | 20.28 |
| 420 | | 3.95 | | | | | 1.99 | |
| 421 | | | | 9.23 | | | | |
| 422 | | | | 19.62 | | | | |
| 423 | | | | 14.56 | | | | |
| 426 | 2.17 | 1.37 | | 28.78 | | 2.00 | 0.98 | 2.08 |
| 427 | | | | 7.71 | | | | |
| 428 | 12.60 | 4.03 | | | | 4.93 | 1.94 | 2.57 |
| 429 | 26.33 | 10.61 | | | | 19.31 | 9.26 | 17.17 |
| 430 | 22.37 | 8.29 | | | | 16.88 | 7.40 | 15.03 |
| 431 | | | | 10.72 | | | | |
| 432 | 1.25 | 0.83 | | | | 0.94 | 0.81 | 1.12 |
| 433 | | 12.40 | | | | | 5.14 | |
| 434 | | | | 1.02 | | | | |
| 435 | | | | 7.58 | | | | |
| 436 | 2.44 | 1.67 | | | | 1.13 | 0.87 | 1.18 |
| 437 | | | | 8.00 | | | | |
| 438 | 27.82 | 13.19 | | | | 15.98 | 11.33 | 5.97 |
| 439 | | | | 8.20 | | | | |
| 440 | | 13.80 | | | | | 3.53 | |
| 441 | | 9.54 | | | | | 2.76 | |
| 442 | 13.93 | 8.33 | 8.58 | 8.39 | | 9.95 | 7.98 | 8.24 |
| 443 | | | | 1.18 | | | | |

TABLE 1-2-continued

Binding to Wild-Type SARS-CoV-2 (Live Cell Assay)

| Antibody ID | A | B | C | D | E | F | G | H |
|---|---|---|---|---|---|---|---|---|
| 444 | | 1.37 | | | | | 1.09 | |
| 445 | | 18.08 | 14.73 | 14.59 | | | 9.16 | |
| 446 | | | | 7.99 | | | | |
| 447 | | 16.90 | 15.76 | 16.77 | | | 17.63 | |
| 448 | | 6.22 | | | | | 2.45 | |
| 449 | | 23.27 | | | | | 19.58 | |
| 450 | | 1.05 | | | | | 0.85 | |
| 451 | | 7.40 | | | | | 6.12 | |
| 452 | | | | 26.81 | | | | |
| 453 | 12.56 | 7.65 | | 9.98 | | 9.58 | 7.71 | 5.44 |
| 454 | | | | 29.60 | | | | |
| 455 | | 7.87 | | | | | 8.10 | |
| 456 | | | | 9.25 | | | | |
| 457 | 1.28 | 0.90 | | 14.83 | | 1.10 | 0.88 | 1.04 |
| 458 | | 7.35 | | | | | 4.19 | |
| 459 | 13.07 | 8.75 | | | | 9.87 | 8.14 | 8.23 |
| 460 | | 1.13 | | | | | 0.97 | |
| 461 | | 11.29 | | | | | 4.47 | |
| 462 | | 15.89 | 12.71 | 13.17 | | | 10.13 | |
| 463 | | 11.71 | | | | | 9.98 | |
| 464 | | 0.87 | | | | | 0.83 | |
| 465 | | 22.04 | | | | | 9.46 | |
| 466 | 1.14 | 0.89 | | 1.91 | | 0.90 | 0.85 | 1.00 |
| 467 | | 8.20 | | | | | 6.50 | |
| 468 | | 22.65 | | | | | 17.21 | |
| 469 | | 5.29 | | | | | 1.43 | |
| 470 | | | | 20.69 | | | | |
| 471 | | | | 3.03 | | | | |
| 472 | | 1.05 | | | | | 0.91 | |
| 473 | 43.89 | 28.68 | | | | 31.30 | 23.32 | 24.10 |
| 474 | | | | 1.49 | | | | |
| 475 | | | | 32.23 | | | | |
| 476 | | | | 18.19 | | | | |
| 477 | | | | 30.73 | | | | |
| 478 | 17.42 | 8.81 | | | | 10.65 | 7.13 | 8.31 |
| 479 | | 2.29 | 1.47 | 1.28 | | | 1.42 | |
| 480 | | | | 9.77 | | | | |
| 481 | | 15.65 | 15.58 | 18.13 | | | 14.00 | |
| 482 | | 4.48 | | | | | 2.31 | |
| 483 | | 26.11 | 30.69 | 26.79 | | | 20.44 | |
| 484 | 20.01 | 9.73 | | | | 11.41 | 8.15 | 9.01 |
| 485 | | | | 1.37 | | | | |
| 486 | 13.61 | 8.35 | | | | 9.20 | 7.06 | 7.04 |
| 487 | | | | 1.76 | | | | |
| 488 | 32.82 | 12.66 | 24.35 | 23.96 | | 17.37 | 11.34 | 6.50 |
| 489 | | 11.32 | | | | | 8.74 | |
| 490 | | 1.07 | | 1.28 | | | 1.08 | |
| 491 | 14.25 | 8.47 | | 9.96 | | 10.06 | 7.86 | 7.40 |
| 492 | | | | 9.25 | | | | |
| 493 | | 1.26 | | | | | 1.10 | |
| 494 | | 14.22 | 11.72 | 12.40 | | | 7.29 | |
| 495 | | 1.23 | | | | | 0.83 | |
| 496 | | | | 19.70 | | | | |
| 497 | | | | 28.32 | | | | |
| 498 | | | | 1.69 | | | | |
| 499 | | 1.35 | | | | | 0.90 | |
| 500 | 13.37 | 8.58 | | | | 9.94 | 7.56 | 7.70 |
| 501 | | 32.38 | | | | | 4.87 | |
| 502 | 28.56 | 18.49 | | | | 18.98 | 14.68 | 7.68 |
| 503 | | 1.87 | | | | | 1.22 | |
| 504 | | | | 2.78 | | | | |
| 505 | | | | 1.55 | | | | |
| 506 | | 30.07 | 30.76 | 22.32 | | | 18.96 | |
| 507 | | | | 1.51 | | | | |
| 508 | 7.41 | 2.94 | | | | 2.50 | 1.11 | 1.48 |
| 509 | | | | 10.19 | | | | |
| 510 | | | | 1.18 | | | | |
| 511 | | 9.99 | | | | | 7.72 | |
| 512 | | | | 30.25 | | | | |
| 513 | | 8.42 | | | | | 7.37 | |
| 514 | | | | 1.04 | | | | |
| 515 | | 10.37 | | | | | 3.93 | |
| 516 | | | | 3.31 | | | | |
| 517 | | | | 10.32 | | | | |
| 518 | 16.49 | 8.65 | | | | 10.43 | 7.25 | 8.31 |
| 519 | 11.35 | 5.82 | | | | 5.56 | 3.78 | 2.99 |

TABLE 1-2-continued

| Binding to Wild-Type SARS-CoV-2 (Live Cell Assay) | | | | | | | | |
|---|---|---|---|---|---|---|---|---|
| Antibody ID | A | B | C | D | E | F | G | H |
| 520 |  | 8.90 |  |  |  |  | 7.29 |  |
| 521 |  | 2.42 |  |  |  |  | 0.86 |  |
| 522 |  |  |  | 9.18 |  |  |  |  |
| 523 |  |  |  | 5.18 |  |  |  |  |
| 524 |  | 0.58 |  |  |  |  | 0.55 |  |
| 525 |  | 8.70 |  |  |  |  | 7.47 |  |
| 526 | 10.16 | 5.86 |  |  |  | 3.45 | 2.03 | 2.17 |
| 527 |  |  |  | 10.36 |  |  |  |  |
| 528 | 23.21 | 11.94 |  |  |  | 8.72 | 5.31 | 2.99 |
| 529 | 1.65 | 0.78 |  |  |  | 1.37 | 0.74 | 1.47 |
| 530 | 11.80 | 5.76 |  |  |  | 3.97 | 2.24 | 2.02 |
| 531 |  |  |  | 7.45 |  |  |  |  |
| 532 | 40.22 | 15.17 |  |  |  | 27.74 | 20.08 | 14.53 |
| 533 |  |  |  | 4.31 |  |  |  |  |
| 534 |  | 12.13 |  |  |  |  | 5.22 |  |
| 535 |  | 50.14 |  |  |  |  | 48.91 |  |
| 536 |  |  |  | 2.36 |  |  |  |  |
| 537 |  |  |  | 4.42 |  |  |  |  |
| 538 |  |  |  | 1.96 |  |  |  |  |
| 539 |  | 24.95 | 16.77 | 21.19 |  |  | 12.22 |  |
| 540 |  | 8.05 | 8.45 | 8.15 |  |  | 7.25 |  |
| 541 |  |  |  | 1.10 |  |  |  |  |
| 542 |  |  |  | 7.52 |  |  |  |  |
| 543 |  |  |  | 13.30 |  |  |  |  |
| 544 |  |  |  | 2.48 |  |  |  |  |
| 545 |  |  |  | 20.57 |  |  |  |  |
| 546 |  |  |  | 19.29 |  |  |  |  |
| 547 |  |  |  | 10.64 |  |  |  |  |
| 548 |  |  | 9.26 |  |  |  |  |  |
| 549 |  | 14.91 | 1.17 | 1.16 |  |  | 11.73 |  |
| 550 |  |  |  | 1.12 |  |  |  |  |
| 551 |  |  |  | 2.48 |  |  |  |  |
| 552 |  | 4.37 | 3.42 | 4.76 |  |  | 1.58 |  |
| 553 |  | 0.85 | 1.21 | 1.47 |  |  | 0.78 |  |
| 554 |  | 8.67 |  |  |  |  | 7.21 |  |
| 555 |  | 13.84 | 27.55 | 28.72 |  |  | 16.18 |  |
| 556 |  |  |  | 7.59 |  |  |  |  |
| 557 |  | 10.02 |  |  |  |  | 7.10 |  |
| 558 |  | 9.48 |  |  |  |  | 8.06 |  |
| 559 |  | 15.91 |  | 1.38 |  |  | 8.40 |  |
| 560 |  |  |  | 22.81 |  |  |  |  |
| 561 |  | 10.44 |  |  |  |  | 7.44 |  |
| 562 |  | 17.30 | 7.64 | 8.57 |  |  | 15.43 |  |
| 563 |  |  |  | 9.67 |  |  |  |  |
| 564 |  |  |  | 10.78 |  |  |  |  |
| 565 |  | 1.31 |  |  |  |  | 1.11 |  |
| 566 |  |  |  | 31.54 |  |  |  |  |
| 567 |  | 8.03 |  |  |  |  | 5.10 |  |
| 568 |  | 8.70 |  |  |  |  | 3.85 |  |
| 569 |  |  |  | 8.78 |  |  |  |  |
| 570 |  | 16.53 |  |  |  |  | 14.76 |  |
| 571 |  |  |  | 8.30 |  |  |  |  |
| 572 |  | 0.72 |  | 9.54 |  |  | 0.67 |  |
| 573 |  | 1.09 |  | 21.55 |  |  | 1.09 |  |
| 574 |  | 7.47 |  |  |  |  | 5.06 |  |
| 575 |  | 24.84 |  |  |  |  | 21.10 |  |
| 576 |  |  |  | 8.75 |  |  |  |  |
| 577 |  | 1.26 |  |  |  |  | 1.14 |  |
| 579 |  | 1.61 |  |  |  |  | 1.16 |  |
| 580 |  |  |  | 11.74 |  |  |  |  |
| 581 |  |  |  | 36.09 |  |  |  |  |
| 582 |  |  |  | 19.63 |  |  |  |  |
| 583 |  |  |  | 8.54 |  |  |  |  |
| 584 |  | 3.72 |  |  |  |  | 1.24 |  |
| 585 |  | 16.33 |  |  |  |  | 13.84 |  |
| 586 |  |  |  | 1.18 |  |  |  |  |
| 587 |  | 5.47 |  |  |  |  | 2.08 |  |
| 588 |  |  |  | 32.67 |  |  |  |  |

TABLE 1-3

| Reactivity with SARS-CoV-2 mutants | | | | | | | |
|---|---|---|---|---|---|---|---|
| Antibody ID | A | B | C | D | E | F | G |
| 258 | 23.72 | | 10.33 | | | 42.93 | 6.88 |
| 259 | | | 1.83 | | | | |
| 260 | | | 11.04 | | | | |
| 261 | 91.23 | | 41.86 | | | 59.94 | 87.01 |
| 262 | 1.44 | | 1.63 | 1.08 | 1.24 | | |
| 263 | | | 17.27 | | | | |
| 264 | | | 11.10 | | | | |
| 265 | | | 14.53 | | | | |
| 266 | | | 10.84 | | | | |
| 267 | | | 3.03 | | | | |
| 268 | 1.11 | | 11.35 | | | 8.90 | 8.18 |
| 269 | 22.84 | | 11.58 | | | 25.35 | 4.83 |
| 270 | | | 2.45 | | | | |
| 271 | | | 8.53 | | | | |
| 272 | 88.35 | | 40.81 | | | 40.41 | 79.72 |
| 273 | | | 16.00 | | | | |
| 274 | 65.52 | | 4.35 | 1.01 | | 31.84 | 61.17 |
| 275 | 24.06 | | 12.79 | | | 38.40 | 6.84 |
| 276 | | | 11.11 | | | | |
| 277 | 26.19 | | 11.67 | | | 41.89 | 9.35 |
| 278 | 76.99 | | 27.61 | | | 61.95 | 70.91 |
| 279 | 11.80 | | 8.20 | | | 13.40 | 2.37 |
| 280 | 66.12 | | 30.06 | | | 42.78 | 68.35 |
| 281 | | | 20.29 | | | | |
| 283 | 30.58 | | 16.31 | | | 36.22 | 8.17 |
| 284 | | | 22.02 | | | | |
| 285 | 67.60 | | 36.55 | | | 48.91 | 84.33 |
| 286 | 8.64 | | 11.86 | | | 28.16 | 6.17 |
| 287 | 88.80 | | 38.05 | | | 60.87 | 87.37 |
| 288 | | | 18.73 | | | | |
| 290 | | | 1.51 | | | | |
| 291 | 31.06 | | 16.58 | | | 33.92 | 8.03 |
| 292 | 47.28 | 13.15 | 25.85 | 12.92 | | 23.61 | 42.77 |
| 294 | | | 18.44 | | | | |
| 295 | | | 9.93 | | | | |
| 296 | 0.68 | | 1.27 | | | 1.01 | 0.95 |
| 297 | 27.96 | | 12.88 | | | 44.70 | 8.63 |
| 298 | 69.72 | | 49.21 | | | 35.71 | 66.84 |
| 299 | | | 2.18 | | | | |
| 300 | | | 10.19 | | | | |
| 301 | | | 21.31 | | | | |
| 302 | 37.89 | | 24.64 | | | 26.48 | 45.35 |
| 303 | | | 10.02 | | | | |
| 304 | 1.00 | | 0.66 | | | 0.99 | 0.97 |
| 305 | 86.93 | | 58.08 | | | 41.01 | 78.88 |
| 306 | | | 2.89 | | | | |
| 307 | 13.85 | | 8.22 | | | 8.47 | 9.73 |
| 308 | 30.41 | | 15.62 | | | 33.36 | 7.93 |
| 309 | 26.61 | 10.37 | 11.69 | 10.70 | | 41.22 | 8.01 |
| 310 | 20.36 | | 13.44 | | | 28.06 | 5.35 |
| 311 | 56.69 | | 30.52 | | | 29.57 | 59.66 |
| 312 | 24.72 | | 13.46 | | | 11.26 | 24.51 |
| 313 | 30.28 | | 14.80 | | | 35.14 | 8.14 |
| 314 | 42.80 | | 51.60 | | | 19.62 | 30.43 |
| 315 | | | 8.39 | | | | |
| 316 | | | 10.43 | | | | |
| 317 | | | 10.32 | | | | |
| 318 | 34.78 | | 17.97 | | | 40.26 | 9.92 |
| 319 | | | 10.57 | | | | |
| 320 | | | 19.72 | | | | |
| 321 | 15.85 | | 4.03 | | | 3.81 | 11.75 |
| 322 | 2.29 | | 4.95 | | | 1.54 | 3.07 |
| 323 | | | 18.97 | | | | |
| 324 | | | 24.90 | | | | |
| 325 | 2.31 | | 1.17 | | | 1.65 | 1.11 |
| 326 | | | 10.16 | | | | |
| 327 | | | 10.39 | | | | |
| 328 | | | 4.00 | | | | |
| 329 | | | 10.62 | | | | |
| 330 | 55.05 | | 37.16 | | | 22.41 | 56.53 |
| 331 | | | 18.09 | | | | |
| 332 | | | 1.93 | | | | |
| 333 | | | 1.19 | | | | |
| 334 | 23.68 | | 12.99 | | | 29.66 | 6.38 |
| 335 | 1.00 | | 9.08 | 7.26 | 6.07 | 1.78 | 1.78 |
| 335 | | | 6.07 | | | | |

TABLE 1-3-continued

| Reactivity with SARS-CoV-2 mutants | | | | | | | |
|---|---|---|---|---|---|---|---|
| Antibody ID | A | B | C | D | E | F | G |
| 336 | 31.95 | | 34.03 | | | 13.90 | 29.45 |
| 337 | | | 2.25 | | | | |
| 338 | 28.71 | | 13.51 | | | 33.19 | 7.81 |
| 339 | | | 18.23 | | | | |
| 340 | | | 26.27 | | | | |
| 341 | 1.06 | | 1.01 | | | 2.18 | 2.22 |
| 342 | | | 4.88 | | | | |
| 343 | | | 1.22 | | | | |
| 344 | | | 8.15 | | | | |
| 345 | | | 9.41 | | | | |
| 346 | 9.53 | | 5.63 | | | 7.05 | 8.57 |
| 347 | | | 8.57 | | | | |
| 348 | | | 14.18 | | | | |
| 349 | | | 1.65 | | | | |
| 350 | 99.30 | | 26.95 | | | 59.37 | 90.02 |
| 351 | | | 0.90 | | | | |
| 352 | 19.28 | | 18.13 | | | 1.08 | 0.94 |
| 353 | 29.41 | | 18.82 | | | 45.27 | 8.84 |
| 354 | 17.09 | | 9.80 | | | 33.17 | 5.07 |
| 355 | 16.81 | | 12.11 | | | 8.08 | 20.27 |
| 356 | 95.46 | | 36.82 | | | 60.38 | 90.79 |
| 357 | 24.02 | | 12.06 | | | 28.02 | 5.37 |
| 358 | 27.31 | | 13.63 | | | 38.39 | 8.74 |
| 359 | 24.40 | | 10.06 | | | 38.77 | 6.88 |
| 360 | 17.97 | | 10.00 | | | 33.90 | 4.92 |
| 361 | 30.83 | | 14.44 | | | 28.28 | 8.06 |
| 362 | | | 10.28 | | | | |
| 363 | | | 15.05 | | | | |
| 364 | 9.44 | 17.75 | 35.04 | 21.95 | | 2.12 | 2.22 |
| 365 | | | 11.22 | | | | |
| 366 | | | 9.74 | | | | |
| 367 | | | 16.30 | | | | |
| 368 | 68.21 | | 39.13 | | | 31.55 | 64.35 |
| 369 | 21.18 | | 9.35 | | | 36.25 | 6.12 |
| 370 | 34.51 | | 16.97 | | | 35.28 | 9.47 |
| 371 | 2.93 | | 2.27 | | | 3.85 | 1.61 |
| 372 | | | 18.09 | | | | |
| 373 | 59.91 | 18.35 | 27.26 | 15.41 | | 42.79 | 59.37 |
| 374 | 2.38 | | 1.22 | | | 3.10 | 1.11 |
| 375 | | | 3.67 | | | | |
| 377 | 1.05 | | 1.09 | | | 0.99 | 0.92 |
| 378 | | | 14.35 | | | | |
| 379 | | | 1.30 | | | | |
| 380 | | | 1.27 | | | | |
| 381 | 62.74 | | 29.43 | | | 43.56 | 67.87 |
| 382 | 0.96 | | 0.88 | | | 0.97 | 0.77 |
| 383 | 3.84 | | 1.80 | | | 11.38 | 6.38 |
| 384 | 30.14 | | 15.65 | | | 44.85 | 8.74 |
| 385 | | | 8.16 | | | | |
| 386 | 1.08 | | 11.73 | 10.06 | | 1.20 | 0.80 |
| 387 | 15.80 | | 11.04 | | | 6.69 | 15.92 |
| 388 | 28.17 | 10.64 | 12.43 | 10.46 | | 43.43 | 8.68 |
| 389 | 3.16 | | 1.24 | | | 2.29 | 1.52 |
| 390 | 2.65 | | 1.36 | | | 3.43 | 1.15 |
| 391 | 36.73 | | 12.45 | | | 18.77 | 35.65 |
| 392 | | | 1.02 | | | | |
| 393 | 25.98 | | 13.62 | | | 39.34 | 7.44 |
| 394 | 70.93 | | 44.22 | | | 37.83 | 63.40 |
| 395 | | | 8.92 | | | | |
| 396 | | | 3.34 | | | | |
| 397 | 29.46 | | 17.73 | | | 32.81 | 7.97 |
| 398 | | | 9.00 | | | | |
| 399 | 64.80 | | 25.35 | | | 30.56 | 70.12 |
| 400 | 65.26 | | 51.70 | | | 37.37 | 66.79 |
| 401 | 30.99 | | 14.52 | | | 35.51 | 8.76 |
| 402 | 71.22 | | 24.90 | | | 46.90 | 67.78 |
| 403 | 23.69 | | 10.33 | | | 35.65 | 7.47 |
| 404 | 23.52 | | 12.58 | | | 27.36 | 6.02 |
| 405 | | | 7.51 | | | | |
| 407 | | | 2.28 | | | | |
| 408 | 39.16 | 9.44 | 22.27 | 12.51 | | 29.52 | 36.22 |
| 409 | | | 9.21 | | | | |
| 410 | 8.75 | | 6.87 | | | 7.64 | 17.91 |
| 411 | 1.07 | | 16.28 | 7.86 | | 1.06 | 0.79 |
| 412 | | | 13.12 | | | | |
| 413 | 3.75 | | 1.67 | | | 3.41 | 1.32 |

TABLE 1-3-continued

| Reactivity with SARS-CoV-2 mutants | | | | | | | |
|---|---|---|---|---|---|---|---|
| Antibody ID | A | B | C | D | E | F | G |
| 414 | 75.18 | 20.88 | 35.05 | 23.48 | | 49.20 | 78.55 |
| 415 | 29.15 | | 10.95 | | | 42.39 | 8.14 |
| 416 | | | 1.09 | | | | |
| 417 | 7.38 | 2.18 | 2.13 | 2.04 | | 7.71 | 2.12 |
| 418 | | | 11.97 | | | | |
| 419 | 86.33 | 21.62 | 52.30 | 21.43 | | 40.72 | 70.63 |
| 420 | 12.38 | | 13.73 | | | 7.59 | 2.50 |
| 421 | | | 9.33 | | | | |
| 422 | | | 15.24 | | | | |
| 423 | | | 15.26 | | | | |
| 426 | 1.52 | | 32.58 | 23.81 | | 1.37 | 1.17 |
| 427 | | | 5.61 | | | | |
| 428 | 8.00 | | 4.93 | | | 14.45 | 1.51 |
| 429 | 26.33 | | 12.20 | | | 40.90 | 8.50 |
| 430 | 26.48 | | 11.04 | | | 38.30 | 9.17 |
| 431 | | | 11.65 | | | | |
| 432 | 1.04 | | 0.82 | | | 1.06 | 0.88 |
| 433 | 28.73 | | 19.75 | | | 12.34 | 23.05 |
| 434 | | | 1.34 | | | | |
| 435 | | | 7.93 | | | | |
| 436 | 1.70 | | 0.85 | | | 2.31 | 1.00 |
| 437 | | | 4.71 | | | | |
| 438 | 73.72 | | 26.10 | | | 43.96 | 71.20 |
| 439 | | | 9.01 | | | | |
| 440 | 17.38 | | 16.55 | | | 7.17 | 15.81 |
| 441 | 12.42 | | 9.04 | | | 6.24 | 14.86 |
| 442 | 25.79 | 10.40 | 10.26 | 10.31 | | 38.14 | 7.29 |
| 443 | | | 0.93 | | | | |
| 444 | 1.32 | | 2.50 | | | 1.10 | 1.09 |
| 445 | 58.93 | 13.58 | 28.73 | 13.67 | | 30.82 | 54.86 |
| 446 | | | 6.16 | | | | |
| 447 | 51.18 | 11.25 | 21.68 | 11.18 | | 35.27 | 43.98 |
| 448 | 14.84 | | 6.99 | | | 5.79 | 13.34 |
| 449 | 82.69 | | 51.64 | | | 36.87 | 68.06 |
| 450 | 0.93 | | 1.27 | | | 1.01 | 0.95 |
| 451 | 23.37 | | 13.85 | | | 29.93 | 6.29 |
| 452 | | | 0.97 | | | | |
| 453 | 25.63 | | 10.63 | 7.84 | | 39.35 | 7.41 |
| 454 | | | 19.73 | | | | |
| 455 | 30.58 | | 14.24 | | | 32.32 | 8.24 |
| 456 | | | 8.16 | | | | |
| 457 | 1.01 | | 22.86 | 14.46 | | 1.14 | 0.75 |
| 458 | 22.72 | | 14.68 | | | 27.44 | 6.23 |
| 459 | 26.02 | | 11.69 | | | 40.82 | 8.07 |
| 460 | 2.05 | | 1.63 | | | 2.42 | 1.07 |
| 461 | 30.03 | | 24.42 | | | 6.89 | 27.84 |
| 462 | 50.03 | 9.72 | 18.76 | 9.59 | | 42.75 | 54.75 |
| 463 | 38.25 | | 9.56 | | | 43.84 | 8.36 |
| 464 | 1.04 | | 1.00 | | | 1.04 | 0.86 |
| 465 | 75.70 | | 24.73 | | | 37.29 | 68.30 |
| 466 | 1.15 | | 3.81 | 1.94 | | 1.10 | 0.75 |
| 467 | 27.23 | | | 16.17 | | 30.57 | 7.54 |
| 468 | 70.65 | | 53.95 | | | 34.57 | 57.63 |
| 469 | 6.59 | | 10.41 | | | 3.33 | 5.13 |
| 470 | | | 7.63 | | | | |
| 471 | | | 2.75 | | | | |
| 472 | 2.35 | | 2.49 | | | 3.19 | 1.22 |
| 473 | 85.60 | | 40.48 | | | 52.91 | 85.20 |
| 474 | | | 1.05 | | | | |
| 475 | | | 20.18 | | | | |
| 476 | | | 14.06 | | | | |
| 477 | | | 23.93 | | | | |
| 478 | 24.54 | | 9.85 | | | 38.85 | 6.68 |
| 479 | 5.19 | 1.72 | 1.26 | 1.30 | | 4.31 | 1.54 |
| 480 | | | 10.68 | | | | |
| 481 | 67.86 | 12.60 | 22.27 | 14.26 | | 46.55 | 62.21 |
| 482 | 12.36 | | 4.37 | | | 2.89 | 14.35 |
| 483 | 103.79 | 22.62 | 55.72 | 21.95 | | 48.21 | 98.05 |
| 484 | 28.39 | | 11.13 | | | 43.00 | 8.15 |
| 485 | | | 1.11 | | | | |
| 486 | 23.47 | | 10.13 | | | 37.05 | 6.79 |
| 487 | | | 1.28 | | | | |
| 488 | 75.86 | 22.75 | 34.95 | 22.44 | | 52.57 | 79.42 |
| 489 | 36.73 | | 8.61 | | | 40.68 | 7.95 |
| 490 | 1.15 | | 1.13 | 1.52 | | 1.14 | 1.03 |
| 491 | 26.57 | | 11.57 | 7.97 | | 38.81 | 7.45 |

TABLE 1-3-continued

| Reactivity with SARS-CoV-2 mutants | | | | | | | |
|---|---|---|---|---|---|---|---|
| Antibody ID | A | B | C | D | E | F | G |
| 492 | | | 7.71 | | | | |
| 493 | 4.63 | | 2.26 | | | 4.82 | 1.72 |
| 494 | 44.93 | 9.51 | 32.44 | 9.93 | | 33.28 | 55.86 |
| 495 | 3.47 | | 1.65 | | | 3.82 | 1.43 |
| 496 | | | 12.62 | | | | |
| 497 | | | 22.21 | | | | |
| 498 | | | 0.95 | | | | |
| 499 | 4.39 | | 2.60 | | | 1.18 | 4.30 |
| 500 | 25.40 | | 12.06 | | | 39.05 | 6.98 |
| 501 | 38.82 | | 58.69 | | | 29.96 | 46.12 |
| 502 | 75.66 | | 33.69 | | | 51.78 | 77.33 |
| 503 | 2.13 | | 56.95 | | | 1.64 | 2.24 |
| 504 | | | 2.47 | | | | |
| 505 | | | 1.00 | | | | |
| 506 | 84.86 | 21.28 | 55.34 | 19.71 | | 42.26 | 69.46 |
| 507 | | | 1.12 | | | | |
| 508 | 3.16 | | 1.73 | | | 2.71 | 3.99 |
| 509 | | | 11.41 | | | | |
| 510 | | | 1.06 | | | | |
| 511 | 30.09 | | 15.44 | | | 31.27 | 8.27 |
| 512 | | | 17.78 | | | | |
| 513 | 29.60 | | 14.98 | | | 35.81 | 8.11 |
| 514 | | | 1.39 | | | | |
| 515 | 20.24 | | 22.33 | | | 9.43 | 21.56 |
| 516 | | | 2.61 | | | | |
| 517 | | | 11.46 | | | | |
| 518 | 27.07 | | 11.02 | | | 39.74 | 7.56 |
| 519 | 16.48 | | 6.13 | | | 30.76 | 4.93 |
| 520 | 27.90 | | 14.55 | | | 31.20 | 7.60 |
| 521 | 2.72 | | 5.78 | | | 1.68 | 2.68 |
| 522 | | | 6.75 | | | | |
| 523 | | | 3.76 | | | | |
| 524 | 0.99 | | 1.25 | | | 1.12 | 0.85 |
| 525 | 28.03 | | 18.43 | | | 32.40 | 7.12 |
| 526 | 8.86 | | 2.82 | | | 9.69 | 6.76 |
| 527 | | | 7.97 | | | | |
| 528 | 19.27 | | 9.66 | | | 31.23 | 3.71 |
| 529 | 1.19 | | 2.02 | | | 0.98 | 0.77 |
| 530 | 11.91 | | 3.47 | | | 8.39 | 8.68 |
| 531 | | | 8.14 | | | | |
| 532 | 82.82 | | 37.09 | | | 45.13 | 74.93 |
| 533 | | | 4.86 | | | | |
| 534 | 53.33 | | 17.02 | | | 42.90 | 55.16 |
| 535 | 108.81 | | 32.53 | | | 64.49 | 93.16 |
| 536 | | | 2.59 | | | | |
| 537 | | | 3.74 | | | | |
| 538 | | | 1.48 | | | | |
| 539 | 62.31 | 17.22 | 43.72 | 18.37 | | 27.05 | 52.98 |
| 540 | 29.98 | 9.07 | 15.43 | 9.58 | | 30.28 | 8.41 |
| 541 | | | 1.60 | | | | |
| 542 | | | 8.41 | | | | |
| 543 | | | 8.92 | | | | |
| 544 | | | 1.58 | | | | |
| 545 | | | 14.34 | | | | |
| 546 | | | 18.95 | | | | |
| 547 | | | 11.36 | | | | |
| 548 | | | 10.05 | | | | |
| 549 | 84.96 | 16.67 | 0.64 | 1.50 | | 55.32 | 82.00 |
| 550 | | | 1.46 | | | | |
| 551 | | | 1.70 | | | | |
| 552 | 14.18 | 2.77 | 11.30 | 3.46 | | 13.19 | 23.53 |
| 553 | 2.42 | 1.20 | 1.20 | 1.57 | | 2.72 | 1.20 |
| 554 | 25.25 | | 11.74 | | | 38.34 | 7.49 |
| 555 | 62.72 | 19.48 | 28.50 | 20.07 | | 42.59 | 68.10 |
| 556 | | | 7.35 | | | | |
| 557 | 23.76 | | 12.51 | | | 36.28 | 7.35 |
| 558 | 30.48 | | 16.05 | | | 33.78 | 8.19 |
| 559 | 49.04 | | 1.20 | 1.10 | | 25.42 | 49.47 |
| 560 | | | 14.80 | | | | |
| 561 | 26.03 | | 13.15 | 40.78 | 8.07 | | |
| 562 | 35.88 | 9.85 | 9.23 | 10.13 | | 42.03 | 8.13 |
| 563 | | | 10.47 | | | | |
| 564 | | | 11.65 | | | | |
| 565 | 1.05 | | 0.94 | | | 0.96 | 0.93 |
| 566 | | | 18.74 | | | | |
| 567 | 21.30 | | 10.73 | | | 28.64 | 5.41 |

TABLE 1-3-continued

| Reactivity with SARS-CoV-2 mutants | | | | | | | |
|---|---|---|---|---|---|---|---|
| Antibody ID | A | B | C | D | E | F | G |
| 568 | 21.69 | | 10.32 | | | 8.40 | 20.99 |
| 569 | | | 10.37 | | | | |
| 570 | 36.80 | | 9.05 | | | 43.77 | 8.96 |
| 571 | | | 6.77 | | | | |
| 572 | 0.99 | | 11.72 | 10.88 | | 1.08 | 0.86 |
| 573 | 1.17 | | 23.89 | 17.83 | | 1.05 | 0.94 |
| 574 | 19.94 | | 13.15 | | | 27.47 | 5.03 |
| 575 | 90.42 | | 57.96 | | | 51.44 | 102.62 |
| 576 | | | 10.04 | | | | |
| 577 | 1.68 | | 1.63 | | | 1.92 | 0.99 |
| 579 | 2.02 | | 1.32 | | | 1.95 | 1.89 |
| 580 | | | 8.07 | | | | |
| 581 | | | 60.55 | | | | |
| 582 | | | 12.97 | | | | |
| 583 | | | 11.39 | | | | |
| 584 | 1.34 | | 0.96 | | | 0.99 | 0.92 |
| 585 | 29.09 | | 15.22 | | | 33.00 | 7.49 |
| 586 | | | 1.53 | | | | |
| 587 | 10.99 | | 1.93 | | | 8.33 | 2.38 |
| 588 | | | 44.93 | | | | |

TABLE 1-4

| Cross-reactivity with SARS | | | | | | | | |
|---|---|---|---|---|---|---|---|---|
| Antibody ID | A | B | C | D | E | F | G | H |
| 258 | | 84.75 | | | | | 42.13 | |
| 259 | | | | 1.03 | | | | |
| 260 | | | | 107.52 | | | | |
| 261 | 0.89 | 1.09 | | | | 0.93 | 1.03 | 0.91 |
| 262 | | 0.87 | | | | | 0.88 | |
| 263 | | | | 1.13 | | | | |
| 264 | | | | 55.94 | | | | |
| 265 | | | | 1.09 | | | | |
| 266 | | | | 33.42 | | | | |
| 267 | | | | 16.93 | | | | |
| 268 | 25.86 | 1.17 | | | | 10.35 | 1.02 | 2.84 |
| 269 | | 55.38 | | | | | 33.51 | |
| 270 | | | | 1.34 | | | | |
| 271 | | | | 27.37 | | | | |
| 272 | | 1.18 | | | | | 1.04 | |
| 273 | | | | 1.23 | | | | |
| 274 | | 1.13 | | 1.11 | | | 1.08 | |
| 275 | 36.29 | 64.76 | | | | 16.13 | 32.17 | 7.84 |
| 276 | | | | 117.48 | | | | |
| 277 | 40.33 | 77.67 | | | | 23.59 | 45.94 | 9.94 |
| 278 | 0.96 | 37.87 | | | | 1.03 | 10.66 | 0.98 |
| 279 | | 1.27 | | | | | 1.02 | |
| 280 | 1.03 | 1.09 | | | | 1.00 | 1.05 | 1.00 |
| 281 | | | | 1.10 | | | | |
| 283 | | 1.10 | | | | | 1.18 | |
| 284 | | | | 1.20 | | | | |
| 285 | 1.01 | 1.03 | | | | 1.06 | 0.99 | 1.01 |
| 286 | 22.12 | 22.73 | | | | 7.62 | 6.49 | 1.88 |
| 287 | 0.93 | 1.12 | | | | 0.92 | 1.05 | 0.91 |
| 288 | | | | 1.00 | | | | |
| 290 | | | | 1.25 | | | | |
| 291 | | 58.79 | | | | | 31.31 | |
| 292 | 0.89 | 1.09 | 0.96 | 1.14 | | 0.96 | 1.05 | 0.92 |
| 294 | | | | 1.07 | | | | |
| 295 | | | | 1.24 | | | | |
| 296 | | 0.99 | | | | | 1.08 | |
| 297 | | 102.18 | | | | | 57.83 | |
| 298 | | 1.13 | | | | | 1.11 | |
| 299 | | | | 1.13 | | | | |
| 300 | | | | 74.40 | | | | |
| 301 | | | | 1.45 | | | | |
| 302 | 1.06 | 2.73 | | | | 1.08 | 1.34 | 1.06 |
| 303 | | | | 21.75 | | | | |
| 304 | | 1.13 | | | | | 1.09 | |
| 305 | | 1.09 | | | | | 1.04 | |
| 306 | | | | 1.39 | | | | |

TABLE 1-4-continued

| | Cross-reactivity with SARS | | | | | | | |
|---|---|---|---|---|---|---|---|---|
| Antibody ID | A | B | C | D | E | F | G | H |
| 307 | | 1.21 | | | | | 1.03 | |
| 308 | | 48.28 | | | | | 22.77 | |
| 309 | 60.50 | 90.38 | 49.83 | 48.65 | | 37.72 | 60.05 | 20.77 |
| 310 | | 5.18 | | | | | 1.69 | |
| 311 | | 1.07 | | | | | 0.99 | |
| 312 | | 1.11 | | | | | 1.04 | |
| 313 | | 4.93 | | | | | 1.51 | |
| 314 | | 1.06 | | | | | 1.05 | |
| 315 | | | | 1.07 | | | | |
| 316 | | | | 28.80 | | | | |
| 317 | | | | 1.14 | | | | |
| 318 | | 198.29 | | | | | 130.24 | |
| 319 | | | | 30.64 | | | | |
| 320 | | | | 989.19 | | | | |
| 321 | | 1.14 | | | | | 1.01 | |
| 322 | | 0.95 | | | | | 0.93 | |
| 323 | | | | 1.29 | | | | |
| 324 | | | | 1.14 | | | | |
| 325 | | 1.12 | | | | | 1.03 | |
| 326 | | | | 11.52 | | | | |
| 327 | | | | 33.63 | | | | |
| 328 | | | | 1.22 | | | | |
| 329 | | | | 2.46 | | | | |
| 330 | | 1.10 | | | | | 1.11 | |
| 331 | | | | 1.34 | | | | |
| 332 | | | | 0.99 | | | | |
| 333 | | | | 1.21 | | | | |
| 334 | | 12.47 | | | | | 6.78 | |
| 335 | 1.06 | 1.04 | | 5.85 | 10.23 | 1.08 | 0.96 | 1.10 |
| 335 | | | | 10.23 | | | | |
| 336 | | 1.09 | | | | | 1.08 | |
| 337 | | | | 439.36 | | | | |
| 338 | | 84.79 | | | | | 36.61 | |
| 339 | | | | 1.27 | | | | |
| 340 | | | | 1.26 | | | | |
| 341 | 1.02 | 1.11 | | | | 1.13 | 0.97 | 1.12 |
| 342 | | | | 1.16 | | | | |
| 343 | | | | 1.19 | | | | |
| 344 | | | | 9.62 | | | | |
| 345 | | | | 1.09 | | | | |
| 346 | 1.09 | 1.02 | | | | 1.13 | 0.99 | 1.07 |
| 347 | | | | 51.45 | | | | |
| 348 | | | | 1.16 | | | | |
| 349 | | | | 1.12 | | | | |
| 350 | | 0.94 | | | | | 1.05 | |
| 351 | | | | 1.08 | | | | |
| 352 | | 0.92 | | | | | 1.08 | |
| 353 | 38.44 | 73.63 | | | | 27.63 | 42.98 | 15.85 |
| 354 | 1.20 | 1.90 | | | | 1.08 | 1.20 | 1.04 |
| 355 | | 0.88 | | | | | 0.95 | |
| 356 | 1.05 | 1.17 | | | | 1.09 | 1.11 | 1.12 |
| 357 | | 11.83 | | | | | 4.75 | |
| 358 | 22.46 | 29.76 | | | | 5.87 | 10.02 | 1.77 |
| 359 | 1.04 | 3.15 | | | | 1.20 | 1.26 | 1.08 |
| 360 | 1.17 | 1.03 | | | | 1.18 | 1.03 | 1.09 |
| 361 | | 64.67 | | | | | 39.66 | |
| 362 | | | | 38.15 | | | | |
| 363 | | | | 1.09 | | | | |
| 364 | 1.08 | 0.96 | 1.00 | 1.11 | | 1.18 | 0.98 | 1.09 |
| 365 | | | | 38.59 | | | | |
| 366 | | | | 1.23 | | | | |
| 367 | | | | 1.08 | | | | |
| 368 | | 1.09 | | | | | 1.09 | |
| 369 | 1.58 | 2.10 | | | | 1.19 | 1.11 | 1.11 |
| 370 | | 200.26 | | | | | 132.64 | |
| 371 | | 1.21 | | | | | 0.98 | |
| 372 | | | | 1.08 | | | | |
| 373 | 1.78 | 7.32 | 3.18 | 1.54 | | 0.90 | 1.90 | 0.71 |
| 374 | 0.80 | 1.21 | | | | 0.78 | 1.17 | 0.70 |
| 375 | | | | 1.22 | | | | |
| 377 | | 1.14 | | | | | 0.98 | |
| 378 | | | | 0.99 | | | | |
| 379 | | | | 5.90 | | | | |
| 380 | | | | 1.21 | | | | |
| 381 | 0.89 | 1.16 | | | | 0.92 | 1.20 | 0.72 |
| 382 | 0.91 | 1.06 | | | | 0.91 | 1.06 | 0.72 |

TABLE 1-4-continued

| | Cross-reactivity with SARS | | | | | | | |
|---|---|---|---|---|---|---|---|---|
| Antibody ID | A | B | C | D | E | F | G | H |
| 383 | 196.09 | 523.45 | | | | 59.24 | 162.39 | 10.35 |
| 384 | 64.70 | 158.27 | | | | 52.52 | 106.14 | 21.89 |
| 385 | | | | 59.56 | | | | |
| 386 | 0.99 | 1.01 | | 9.91 | | 1.11 | 1.03 | 0.81 |
| 387 | | 1.02 | | | | | 1.00 | |
| 388 | 33.07 | 87.45 | 29.94 | 33.98 | | 16.78 | 53.32 | 13.05 |
| 389 | | 0.94 | | | | | 0.86 | |
| 390 | | 1.03 | | | | | 1.02 | |
| 391 | | 0.98 | | | | | 1.04 | |
| 392 | | | | 1.08 | | | | |
| 393 | 6.30 | 32.99 | | | | 2.45 | 12.72 | 1.09 |
| 394 | | 1.21 | | | | | 1.12 | |
| 395 | | | | 1.16 | | | | |
| 396 | | | | 1.36 | | | | |
| 397 | | 1.30 | | | | | 1.18 | |
| 398 | | | | 140.88 | | | | |
| 399 | | 1.03 | | | | | 1.00 | |
| 400 | | 0.91 | | | | | 1.00 | |
| 401 | | 20.74 | | | | | 10.07 | |
| 402 | 0.67 | 9.28 | | | | 0.69 | 2.25 | 0.70 |
| 403 | 18.79 | 89.59 | | | | 7.39 | 46.48 | 2.24 |
| 404 | | 1.04 | | | | | 1.04 | |
| 405 | | | | 80.94 | | | | |
| 407 | | | | 1.07 | | | | |
| 408 | 0.75 | 1.21 | 1.08 | 1.12 | | 0.79 | 1.23 | 0.83 |
| 409 | | | | 1.03 | | | | |
| 410 | 0.73 | 1.18 | | | | 0.77 | 1.17 | 0.80 |
| 411 | 0.79 | 0.99 | | 1.05 | | 0.78 | 1.05 | 0.79 |
| 412 | | | | 1.09 | | | | |
| 413 | | 1.72 | | | | | 1.11 | |
| 414 | 0.64 | 0.67 | 0.99 | 1.01 | | 0.69 | 0.93 | 0.77 |
| 415 | 58.68 | 143.01 | | | | 34.50 | 86.00 | 17.24 |
| 416 | | | | 18.99 | | | | |
| 417 | 0.82 | 2.52 | 1.26 | 1.12 | | 0.72 | 1.28 | 0.76 |
| 418 | | | | 66.78 | | | | |
| 419 | | 1.55 | 1.01 | 1.12 | | | 1.19 | |
| 420 | | 1.48 | | | | | 1.10 | |
| 421 | | | | 1.19 | | | | |
| 422 | | | | 1.19 | | | | |
| 423 | | | | 1.23 | | | | |
| 426 | 0.77 | 1.06 | | 1.16 | | 0.81 | 1.06 | 0.91 |
| 427 | | | | 1.14 | | | | |
| 428 | 15.32 | 49.44 | | | | 6.70 | 23.25 | 2.62 |
| 429 | 51.46 | 113.99 | | | | 38.18 | 73.33 | 27.68 |
| 430 | 9.09 | 24.99 | | | | 1.79 | 4.22 | 1.09 |
| 431 | | | | 49.88 | | | | |
| 432 | 0.92 | 0.66 | | | | 0.95 | 0.90 | 0.86 |
| 433 | | 1.28 | | | | | 1.03 | |
| 434 | | | | 1.36 | | | | |
| 435 | | | | 1.15 | | | | |
| 436 | 0.99 | 1.32 | | | | 0.96 | 1.05 | 0.99 |
| 437 | | | | 0.94 | | | | |
| 438 | 0.97 | 1.30 | | | | 0.92 | 1.13 | 0.89 |
| 439 | | | | 1.23 | | | | |
| 440 | | 1.37 | | | | | 1.01 | |
| 441 | | 1.08 | | | | | 1.00 | |
| 442 | 16.74 | 54.82 | 23.05 | 21.17 | | 11.57 | 31.73 | 5.61 |
| 443 | | | | 1.03 | | | | |
| 444 | | 1.00 | | | | | 1.00 | |
| 445 | | 1.24 | 1.06 | 1.17 | | | 1.00 | |
| 446 | | | | 6.58 | | | | |
| 447 | | 1.15 | 1.05 | 1.08 | | | 1.09 | |
| 448 | | 1.46 | | | | | 1.07 | |
| 449 | | 1.55 | | | | | 1.16 | |
| 450 | | 1.49 | | | | | 1.19 | |
| 451 | | 9.59 | | | | | 2.09 | |
| 452 | | | | 1.09 | | | | |
| 453 | 33.13 | 94.86 | | 67.35 | | 16.96 | 39.48 | 5.95 |
| 454 | | | | 1.10 | | | | |
| 455 | | 61.42 | | | | | 10.23 | |
| 456 | | | | 676.27 | | | | |
| 457 | 1.00 | 1.25 | | 1.87 | | 0.92 | 1.09 | 0.96 |
| 458 | | 1.03 | | | | | 1.01 | |
| 459 | 52.25 | 121.73 | | | | 35.53 | 67.90 | 20.46 |
| 460 | | 1.27 | | | | | 1.05 | |
| 461 | | 1.35 | | | | | 1.05 | |

TABLE 1-4-continued

Cross-reactivity with SARS

| Antibody ID | A | B | C | D | E | F | G | H |
|---|---|---|---|---|---|---|---|---|
| 462 | | 1.15 | 1.05 | 1.06 | | | 1.17 | |
| 463 | | 1.21 | | | | | 1.08 | |
| 464 | | 1.43 | | | | | 1.12 | |
| 465 | | 1.49 | | | | | 1.13 | |
| 466 | 0.88 | 1.09 | | 1.01 | | 0.89 | 1.04 | 0.86 |
| 467 | | 24.35 | | | | | 7.32 | |
| 468 | | 1.51 | | | | | 1.13 | |
| 469 | | 1.43 | | | | | 1.00 | |
| 470 | | | | 1.09 | | | | |
| 471 | | | | 104.04 | | | | |
| 472 | | 1.05 | | | | | 1.02 | |
| 473 | 0.99 | 1.19 | | | | 0.87 | 1.04 | 0.88 |
| 474 | | | | 1.10 | | | | |
| 475 | | | | 1.18 | | | | |
| 476 | | | | 1.04 | | | | |
| 477 | | | | 1.30 | | | | |
| 478 | 41.47 | 73.13 | | | | 24.94 | 41.14 | 10.35 |
| 479 | | 1.15 | 1.07 | 1.06 | | | 1.11 | |
| 480 | | | | 53.06 | | | | |
| 481 | | 1.16 | 1.05 | 1.05 | | | 1.02 | |
| 482 | | 1.07 | | | | | 1.01 | |
| 483 | | 1.01 | 1.05 | 1.08 | | | 1.03 | |
| 484 | 49.43 | 109.95 | | | | 24.38 | 53.91 | 10.05 |
| 485 | | | | 1.12 | | | | |
| 486 | 15.95 | 38.62 | | | | 6.35 | 15.17 | 2.25 |
| 487 | | | | 7.25 | | | | |
| 488 | 0.91 | 1.14 | 1.14 | 1.06 | | 0.90 | 1.17 | 0.86 |
| 489 | | 43.18 | | | | | 16.09 | |
| 490 | | 1.12 | | 1.10 | | 1.04 | | |
| 491 | 36.79 | 87.68 | | 39.31 | | 19.94 | 41.36 | 8.41 |
| 492 | | | | 87.12 | | | | |
| 493 | | 1.38 | | | | | 1.07 | |
| 494 | | 0.92 | 1.20 | 1.10 | | 0.96 | | |
| 495 | | 693.74 | | | | | 205.82 | |
| 496 | | | | 1.15 | | | | |
| 497 | | | | 1.23 | | | | |
| 498 | | | | 1.31 | | | | |
| 499 | | 1.51 | | | | | 1.16 | |
| 500 | 1.33 | 2.20 | | | | 0.95 | 1.18 | 0.85 |
| 501 | | 1.54 | | | | | 1.17 | |
| 502 | 0.83 | 1.06 | | | | 0.82 | 1.10 | 0.78 |
| 503 | | 1.12 | | | | | 1.02 | |
| 504 | | | | 344.63 | | | | |
| 505 | | | | 1.04 | | | | |
| 506 | | 1.47 | 1.09 | 0.98 | | | 1.17 | |
| 507 | | | | 1.07 | | | | |
| 508 | 0.89 | 0.76 | | | | 0.89 | 0.93 | 0.83 |
| 509 | | | | 38.76 | | | | |
| 510 | | | | 1.03 | | | | |
| 511 | | 120.39 | | | | | 64.81 | |
| 512 | | | | 1.11 | | | | |
| 513 | | 77.65 | | | | | 35.16 | |
| 514 | | | | 1.15 | | | | |
| 515 | | 1.29 | | | | | 1.08 | |
| 516 | | | | 1.03 | | | | |
| 517 | | | | 26.51 | | | | |
| 518 | 38.75 | 90.18 | | | | 15.26 | 40.14 | 7.54 |
| 519 | 1.04 | 1.77 | | | | 0.85 | 1.08 | 0.86 |
| 520 | | 17.66 | | | | | 10.65 | |
| 521 | | 1.46 | | | | | 1.16 | |
| 522 | | | | 1.21 | | | | |
| 523 | | | | 1.11 | | | | |
| 524 | | 1.44 | | | | | 1.11 | |
| 525 | | 1.66 | | | | | 1.25 | |
| 526 | 1.17 | 3.35 | | | | 0.87 | 1.46 | 0.80 |
| 527 | | | | 31.12 | | | | |
| 528 | 18.25 | 35.31 | | | | 2.75 | 8.12 | 1.23 |
| 529 | 0.93 | 1.24 | | | | 0.86 | 1.21 | 0.82 |
| 530 | 1.62 | 2.96 | | | | 0.92 | 3.42 | 0.86 |
| 531 | | | | 27.60 | | | | |
| 532 | 0.82 | 1.03 | | | | 0.80 | 1.00 | 0.82 |
| 533 | | | | 1.23 | | | | |
| 534 | | 0.88 | | | | | 0.99 | |
| 535 | | 0.98 | | | | | 1.07 | |
| 536 | | | | 928.04 | | | | |
| 537 | | | | 1.04 | | | | |

TABLE 1-4-continued

| | Cross-reactivity with SARS | | | | | | | |
|---|---|---|---|---|---|---|---|---|
| Antibody ID | A | B | C | D | E | F | G | H |
| 538 | | | | 17.64 | | | | |
| 539 | | 1.47 | 1.04 | 1.04 | | | 1.13 | |
| 540 | | 105.72 | 58.27 | 60.70 | | | 59.08 | |
| 541 | | | | 1.20 | | | | |
| 542 | | | | 100.69 | | | | |
| 543 | | | | 1.03 | | | | |
| 544 | | | | 1.05 | | | | |
| 545 | | | | 1.13 | | | | |
| 546 | | | | 1.18 | | | | |
| 547 | | | | 48.01 | | | | |
| 548 | | | | 18.10 | | | | |
| 549 | | 1.08 | 1.00 | 1.39 | | 1.02 | | |
| 550 | | | | 1.41 | | | | |
| 551 | | | | 5.06 | | | | |
| 552 | | 124.24 | 48.20 | 125.49 | | | 6.53 | |
| 553 | | 1.09 | 1.07 | 1.08 | | | 1.06 | |
| 554 | | 27.98 | | | | | 8.45 | |
| 555 | | 1.47 | 1.01 | 1.07 | | | 1.24 | |
| 556 | | | | 1.09 | | | | |
| 557 | | 6.36 | | | | | 1.72 | |
| 558 | | 67.62 | | | | | 15.01 | |
| 559 | | 1.33 | | 1.07 | | | 1.05 | |
| 560 | | | | 1.14 | | | | |
| 561 | | 55.84 | | | | | 27.28 | |
| 562 | | 17.86 | 6.09 | 2.57 | | | 5.67 | |
| 563 | | | | 35.37 | | | | |
| 564 | | | | 37.28 | | | | |
| 565 | | 1.27 | | | | | 1.08 | |
| 566 | | | | 0.97 | | | | |
| 567 | | 1.74 | | | | | 1.13 | |
| 568 | | 0.99 | | | | | 1.07 | |
| 569 | | | | 3.31 | | | | |
| 570 | | 6.92 | | | | | 2.42 | |
| 571 | | | | 1.28 | | | | |
| 572 | | 0.97 | | 30.96 | | | 1.04 | |
| 573 | | 0.94 | | 1.18 | | | 0.92 | |
| 574 | | 1.05 | | | | | 1.01 | |
| 575 | | 0.98 | | | | | 1.06 | |
| 576 | | | | 6.87 | | | | |
| 577 | | 0.92 | | | | | 0.95 | |
| 579 | | 1.07 | | | | | 1.08 | |
| 580 | | | | 1.12 | | | | |
| 581 | | | | 1.14 | | | | |
| 582 | | | | 1.13 | | | | |
| 583 | | | | 115.04 | | | | |
| 584 | | 1.17 | | | | | 1.10 | |
| 585 | | 1.17 | | | | | 0.96 | |
| 586 | | | | 1.36 | | | | |
| 587 | | 2.84 | | | | | 1.20 | |
| 588 | | | | 1.40 | | | | |

TABLE 1-5

| | Cross-reactivity with WIV1 | | | | | | | |
|---|---|---|---|---|---|---|---|---|
| Antibody ID | A | B | C | D | E | F | G | H |
| 258 | | 135.44 | | | | | 58.99 | |
| 259 | | | | 1.03 | | | | |
| 260 | | | | 220.46 | | | | |
| 261 | 1.13 | 1.76 | | | | 0.93 | 1.12 | 0.97 |
| 262 | | 0.98 | | | | | 0.96 | |
| 263 | | | | 1.11 | | | | |
| 264 | | | | 159.96 | | | | |
| 265 | | | | 1.12 | | | | |
| 266 | | | | 96.47 | | | | |
| 267 | | | | 1.32 | | | | |
| 268 | 38.33 | 1.11 | | | | 6.61 | 1.01 | 1.51 |
| 269 | | 47.77 | | | | | 14.12 | |
| 270 | | | | 1.33 | | | | |
| 271 | | | | 34.07 | | | | |
| 272 | | 1.32 | | | | | 1.14 | |
| 273 | | | | 1.28 | | | | |

TABLE 1-5-continued

| | Cross-reactivity with WIV1 | | | | | | | |
|---|---|---|---|---|---|---|---|---|
| Antibody ID | A | B | C | D | E | F | G | H |
| 274 | 1.09 | 1.30 | | | | | 1.19 | |
| 275 | 141.39 | 209.04 | | | | 65.98 | 91.80 | 26.97 |
| 276 | | | | 259.79 | | | | |
| 277 | 158.96 | 211.28 | | | | 69.95 | 96.81 | 26.46 |
| 278 | 1.18 | 59.86 | | | | 1.05 | 13.91 | 1.01 |
| 279 | | 1.16 | | | | | 1.05 | |
| 280 | 1.12 | 1.17 | | | | 1.11 | 1.10 | 1.02 |
| 281 | | | | 1122.43 | | | | |
| 283 | | 1.22 | | | | | 1.18 | |
| 284 | | | | 1.10 | | | | |
| 285 | 1.07 | 1.08 | | | | 1.10 | 0.97 | 1.02 |
| 286 | 38.69 | 34.32 | | | | 8.88 | 7.86 | 1.91 |
| 287 | 1.13 | 1.35 | | | | 0.99 | 1.08 | 0.97 |
| 288 | | | | 1.03 | | | | |
| 290 | | | | 1.22 | | | | |
| 291 | | 143.48 | | | | | 64.83 | |
| 292 | 1.08 | 1.33 | 1.05 | 1.12 | | 1.03 | 1.17 | 1.00 |
| 294 | | | | 1.39 | | | | |
| 295 | | | | 1.29 | | | | |
| 296 | | 0.99 | | | | | 1.08 | |
| 297 | | 242.40 | | | | | 112.89 | |
| 298 | | 1.23 | | | | | 1.15 | |
| 299 | | | | 1.14 | | | | |
| 300 | | | | 243.80 | | | | |
| 301 | | | | 1.41 | | | | |
| 302 | 1.15 | 2.81 | | | | 1.08 | 1.20 | 1.11 |
| 303 | | | | 36.60 | | | | |
| 304 | | 1.01 | | | | | 1.04 | |
| 305 | | 1.22 | | | | | 1.11 | |
| 306 | | | | 1.27 | | | | |
| 307 | | 1.27 | | | | | 1.04 | |
| 308 | | 66.37 | | | | | 20.95 | |
| 309 | 174.39 | 250.30 | 166.19 | 177.69 | | 89.72 | 126.19 | 38.21 |
| 310 | | 52.71 | | | | | 20.81 | |
| 311 | | 1.11 | | | | | 1.14 | |
| 312 | | 1.19 | | | | | 1.10 | |
| 313 | | 8.58 | | | | | 1.92 | |
| 314 | | 1.24 | | | | | 1.12 | |
| 315 | | | | 1.09 | | | | |
| 316 | | | | 93.76 | | | | |
| 317 | | | | 1.06 | | | | |
| 318 | | 290.62 | | | | | 166.40 | |
| 319 | | | | 96.20 | | | | |
| 320 | | | | 736.12 | | | | |
| 321 | | 1.04 | | | | | 1.03 | |
| 322 | | 0.97 | | | | | 0.91 | |
| 323 | | | | 1.34 | | | | |
| 324 | | | | 1.08 | | | | |
| 325 | | 1.30 | | | | | 1.10 | |
| 326 | | | | 8.94 | | | | |
| 327 | | | | 87.70 | | | | |
| 328 | | | | 1.18 | | | | |
| 329 | | | | 1.69 | | | | |
| 330 | | 1.29 | | | | | 1.20 | |
| 331 | | | | 1.25 | | | | |
| 332 | | | | 1.04 | | | | |
| 333 | | | | 1.18 | | | | |
| 334 | | 51.31 | | | | | 15.99 | |
| 335 | | | | 6.68 | | | | |
| 335 | 1.08 | 1.06 | | 3.52 | 6.68 | 1.09 | 0.97 | 1.09 |
| 336 | | 1.15 | | | | | 1.18 | |
| 337 | | | | 280.42 | | | | |
| 338 | | 111.87 | | | | | 32.46 | |
| 339 | | | | 1.24 | | | | |
| 340 | | | | 1.25 | | | | |
| 341 | 1.18 | 1.07 | | | | 1.17 | 0.95 | 1.10 |
| 342 | | | | 1.17 | | | | |
| 343 | | | | 1.17 | | | | |
| 344 | | | | 16.59 | | | | |
| 345 | | | | 1.03 | | | | |
| 346 | 1.14 | 1.07 | | | | 1.17 | 1.03 | 1.15 |
| 347 | | | | 134.18 | | | | |
| 348 | | | | 1.39 | | | | |
| 349 | | | | 1.06 | | | | |
| 350 | | 1.13 | | | | | 1.05 | |
| 351 | | | | 1.12 | | | | |

TABLE 1-5-continued

| | Cross-reactivity with WIV1 | | | | | | | |
|---|---|---|---|---|---|---|---|---|
| Antibody ID | A | B | C | D | E | F | G | H |
| 352 | | 1.16 | | | | | 1.06 | |
| 353 | 159.56 | 250.40 | | | | 96.91 | 133.73 | 45.78 |
| 354 | 1.20 | 1.51 | | | | 1.09 | 1.19 | 1.10 |
| 355 | | 0.96 | | | | 1.01 | | |
| 356 | 1.28 | 1.50 | | | | 1.15 | 1.23 | 1.18 |
| 357 | | 15.57 | | | | | 2.42 | |
| 358 | 51.74 | 67.79 | | | | 8.83 | 16.91 | 2.03 |
| 359 | 1.16 | 3.70 | | | | 1.17 | 1.27 | 1.14 |
| 360 | 1.21 | 1.11 | | | | 1.17 | 1.08 | 1.11 |
| 361 | | 114.31 | | | | | 30.73 | |
| 362 | | | | 119.44 | | | | |
| 363 | | | | 1.14 | | | | |
| 364 | 751.63 | 466.05 | 579.87 | 973.16 | | 408.62 | 117.53 | 221.32 |
| 365 | | | | 128.16 | | | | |
| 366 | | | | 1.23 | | | | |
| 367 | | | | 1.20 | | | | |
| 368 | | 1.32 | | | | | 1.20 | |
| 369 | 1.49 | 2.13 | | | | 1.24 | 1.16 | 1.14 |
| 370 | | 364.65 | | | | | 191.57 | |
| 371 | | 1.27 | | | | | 1.09 | |
| 372 | | | | 1.10 | | | | |
| 373 | 2.06 | 9.84 | 6.08 | 1.74 | | 0.89 | 1.83 | 0.75 |
| 374 | 0.89 | 1.32 | | | | 0.82 | 1.21 | 0.73 |
| 375 | | | | 398.74 | | | | |
| 377 | | 1.14 | | | | | 1.06 | |
| 378 | | | | 272.12 | | | | |
| 379 | | | | 1.29 | | | | |
| 380 | | | | 1.16 | | | | |
| 381 | 1.07 | 1.31 | | | | 0.98 | 1.26 | 0.79 |
| 382 | 0.99 | 1.04 | | | | 0.94 | 1.08 | 0.75 |
| 383 | 35.23 | 74.56 | | | | 5.97 | 16.67 | 1.30 |
| 384 | 172.09 | 339.57 | | | | 88.43 | 180.47 | 39.44 |
| 385 | | | | 161.00 | | | | |
| 386 | 1.12 | 1.06 | | 19.61 | | 1.18 | 1.05 | 0.83 |
| 387 | | 1.22 | | | | | 1.02 | |
| 388 | 129.20 | 269.76 | 163.98 | 160.52 | | 58.29 | 133.80 | 32.50 |
| 389 | | 1.09 | | | | | 1.00 | |
| 390 | | 1.13 | | | | | 1.07 | |
| 391 | | 1.16 | | | | | 1.15 | |
| 392 | | | | 1.04 | | | | |
| 393 | 22.77 | 79.52 | | | | 5.23 | 25.33 | 1.34 |
| 394 | | 1.41 | | | | | 1.30 | |
| 395 | | | | 1.18 | | | | |
| 396 | | | | 1.35 | | | | |
| 397 | | 1.50 | | | | | 1.21 | |
| 398 | | | | 212.69 | | | | |
| 399 | | 1.24 | | | | | 1.12 | |
| 400 | | 1.07 | | | | | 1.05 | |
| 401 | | 75.19 | | | | | 28.91 | |
| 402 | 0.82 | 5.36 | | | | 0.74 | 1.54 | 0.77 |
| 403 | 34.33 | 143.46 | | | | 7.03 | 46.14 | 1.61 |
| 404 | | 1.16 | | | | | 1.02 | |
| 405 | | | | 106.45 | | | | |
| 407 | | | | 1.05 | | | | |
| 408 | 1.08 | 2.03 | 1.51 | 1.78 | | 0.86 | 1.48 | 0.88 |
| 409 | | | | 1.14 | | | | |
| 410 | 0.87 | 1.29 | | | | 0.81 | 1.26 | 0.81 |
| 411 | 0.85 | 1.07 | | 1.09 | | 0.81 | 1.09 | 0.82 |
| 412 | | | | 1.14 | | | | |
| 413 | | 1.60 | | | | | 1.14 | |
| 414 | 0.75 | 0.72 | 1.10 | 1.11 | | 0.72 | 0.98 | 0.82 |
| 415 | 139.01 | 331.46 | | | | 67.79 | 176.30 | 30.30 |
| 416 | | | | 7.85 | | | | |
| 417 | 0.99 | 2.49 | 1.57 | 1.36 | | 0.83 | 1.29 | 0.79 |
| 418 | | | | 251.53 | | | | |
| 419 | | 2.02 | 1.23 | 1.24 | | | 1.26 | |
| 420 | | 1.66 | | | | | 1.15 | |
| 421 | | | | 1.26 | | | | |
| 422 | | | | 1.71 | | | | |
| 423 | | | | 1.19 | | | | |
| 426 | 0.82 | 1.01 | | 1.16 | | 0.82 | 1.05 | 0.94 |
| 427 | | | | 1.11 | | | | |
| 428 | 23.66 | 66.90 | | | | 3.55 | 14.17 | 1.18 |
| 429 | 154.39 | 300.98 | | | | 72.84 | 155.20 | 30.62 |
| 430 | 8.77 | 13.17 | | | | 1.36 | 2.01 | 1.03 |
| 431 | | | | 207.17 | | | | |

TABLE 1-5-continued

| Cross-reactivity with WIV1 | | | | | | | | |
|---|---|---|---|---|---|---|---|---|
| Antibody ID | A | B | C | D | E | F | G | H |
| 432 | 0.94 | 0.64 | | | | 0.94 | 0.91 | 0.94 |
| 433 | | 1.44 | | | | | 1.15 | |
| 434 | | | | 1.29 | | | | |
| 435 | | | | 1.17 | | | | |
| 436 | 1.01 | 1.24 | | | | 0.95 | 1.09 | 1.03 |
| 437 | | | | 0.91 | | | | |
| 438 | 1.05 | 1.34 | | | | 0.94 | 1.18 | 0.97 |
| 439 | | | | 1.17 | | | | |
| 440 | | 1.52 | | | | | 1.02 | |
| 441 | | 1.14 | | | | | 0.97 | |
| 442 | 88.16 | 208.67 | 110.59 | 102.71 | | 45.40 | 105.95 | 19.52 |
| 443 | | | | 1.04 | | | | |
| 444 | | 1.13 | | | | | 0.98 | |
| 445 | | 1.53 | 1.14 | 1.26 | | | 1.05 | |
| 446 | | | | 4.63 | | | | |
| 447 | | 1.28 | 1.07 | 1.26 | | | 1.21 | |
| 448 | | 1.59 | | | | | 1.11 | |
| 449 | | 1172.33 | | | | | 324.64 | |
| 450 | | 1.62 | | | | | 1.10 | |
| 451 | | 122.04 | | | | | 34.74 | |
| 452 | | | | 1.13 | | | | |
| 453 | 62.35 | 143.21 | | 119.96 | | 21.75 | 46.89 | 5.99 |
| 454 | | | | 1.38 | | | | |
| 455 | | 103.30 | | | | | 11.43 | |
| 456 | | | | 16.69 | | | | |
| 457 | 1.01 | 1.19 | | 2.36 | | 0.93 | 1.03 | 1.01 |
| 458 | | 1.15 | | | | | 0.99 | |
| 459 | 143.64 | 295.91 | | | | 78.05 | 150.10 | 35.62 |
| 460 | | 1.16 | | | | | 1.05 | |
| 461 | | 1.59 | | | | | 1.02 | |
| 462 | | 1.19 | 1.09 | 1.06 | | | 1.25 | |
| 463 | | 1.37 | | | | | 1.25 | |
| 464 | | 1.56 | | | | | 1.03 | |
| 465 | | 1.87 | | | | | 1.23 | |
| 466 | 0.92 | 0.98 | | 1.07 | | 0.90 | 1.01 | 0.84 |
| 467 | | 52.61 | | | | | 7.06 | |
| 468 | | 1.67 | | | | | 1.14 | |
| 469 | | 1.59 | | | | | 1.15 | |
| 470 | | | | 1.13 | | | | |
| 471 | | | | 53.28 | | | | |
| 472 | | 1.23 | | | | | 1.08 | |
| 473 | 0.97 | 1.17 | | | | 0.87 | 1.04 | 0.91 |
| 474 | | | | 1.07 | | | | |
| 475 | | | | 1.19 | | | | |
| 476 | | | | 1.09 | | | | |
| 477 | | | | 1.45 | | | | |
| 478 | 85.64 | 144.18 | | | | 34.13 | 48.28 | 9.71 |
| 479 | | 1.27 | 1.16 | 1.27 | | | 1.10 | |
| 480 | | | | 217.74 | | | | |
| 481 | | 1.16 | 1.12 | 1.23 | | | 1.16 | |
| 482 | | 1.21 | | | | | 1.14 | |
| 483 | | 1.17 | 1.10 | 1.07 | | | 1.00 | |
| 484 | 91.14 | 178.22 | | | | 32.22 | 61.46 | 8.95 |
| 485 | | | | 1.08 | | | | |
| 486 | 46.38 | 102.09 | | | | 13.69 | 32.84 | 3.46 |
| 487 | | | | 1.23 | | | | |
| 488 | 1.21 | 1.69 | 1.48 | 1.42 | | 0.94 | 1.26 | 0.96 |
| 489 | | 81.60 | | | | | 25.93 | |
| 490 | | 1.07 | | 1.14 | | | 1.03 | |
| 491 | 119.09 | 253.69 | | 144.60 | | 59.16 | 116.69 | 24.00 |
| 492 | | | | 175.72 | | | | |
| 493 | | 1.86 | | | | | 1.22 | |
| 494 | | 1.14 | 1.15 | 1.19 | | | 0.96 | |
| 495 | | 259.73 | | | | | 46.61 | |
| 496 | | | | 1.12 | | | | |
| 497 | | | | 1.23 | | | | |
| 498 | | | | 1.23 | | | | |
| 499 | | 1.87 | | | | | 1.26 | |
| 500 | 1.38 | 2.32 | | | | 0.92 | 1.21 | 0.91 |
| 501 | | 1.72 | | | | | 1.24 | |
| 502 | 184.46 | 201.31 | | | | 19.08 | 21.84 | 1.33 |
| 503 | | 1.17 | | | | | 1.08 | |
| 504 | | | | 275.76 | | | | |
| 505 | | | | 1.03 | | | | |
| 506 | | 1.70 | 1.14 | 1.10 | | | 1.19 | |
| 507 | | | | 1.12 | | | | |

TABLE 1-5-continued

| Cross-reactivity with WIV1 | | | | | | | | |
|---|---|---|---|---|---|---|---|---|
| Antibody ID | A | B | C | D | E | F | G | H |
| 508 | 0.99 | 1.68 | | | | 0.89 | 1.03 | 0.89 |
| 509 | | | | 116.54 | | | | |
| 510 | | | | 0.94 | | | | |
| 511 | | 243.32 | | | | | 72.04 | |
| 512 | | | | 1.13 | | | | |
| 513 | | 213.97 | | | | | 56.68 | |
| 514 | | | | 1.14 | | | | |
| 515 | | 1.42 | | | | | 1.11 | |
| 516 | | | | 1.05 | | | | |
| 517 | | | | 91.64 | | | | |
| 518 | 104.25 | 209.45 | | | | 34.85 | 91.39 | 13.99 |
| 519 | 1.05 | 1.54 | | | | 0.86 | 1.16 | 0.86 |
| 520 | | 41.49 | | | | | 7.26 | |
| 521 | | 1.59 | | | | | 1.10 | |
| 522 | | | | 1.19 | | | | |
| 523 | | | | 1.08 | | | | |
| 524 | | 1.60 | | | | | 1.15 | |
| 525 | | 1.89 | | | | | 1.24 | |
| 526 | 1.13 | 3.01 | | | | 0.88 | 1.32 | 0.86 |
| 527 | | | | 25.96 | | | | |
| 528 | 6.20 | 6.34 | | | | 1.11 | 1.61 | 0.96 |
| 529 | 0.95 | 1.16 | | | | 0.85 | 1.20 | 0.85 |
| 530 | 1.76 | 2.72 | | | | 0.89 | 4.02 | 0.90 |
| 531 | | | | 80.74 | | | | |
| 532 | 1.17 | 1.46 | | | | 0.94 | 1.21 | 0.91 |
| 533 | | | | 1.30 | | | | |
| 534 | | 1.36 | | | | | 1.11 | |
| 535 | | 1.20 | 1.14 | | | | | |
| 536 | | | | 515.71 | | | | |
| 537 | | | | 1.05 | | | | |
| 538 | | | | 12.14 | | | | |
| 539 | | 1.78 | 1.10 | 1.19 | | | 1.13 | |
| 540 | | 200.24 | 109.04 | 116.13 | | | 64.75 | |
| 541 | | | | 1.17 | | | | |
| 542 | | | | 179.91 | | | | |
| 543 | | | | 1.10 | | | | |
| 544 | | | | 1.30 | | | | |
| 545 | | | | 1.26 | | | | |
| 546 | | | | 2.57 | | | | |
| 547 | | | | 162.78 | | | | |
| 548 | | | | 75.23 | | | | |
| 549 | | 1.60 | 1.41 | 1.14 | | | 1.23 | |
| 550 | | | | 1.42 | | | | |
| 551 | | | | 149.48 | | | | |
| 552 | | 8.82 | 3.07 | 5.85 | | 1.47 | | |
| 553 | | 1.18 | 1.10 | 1.23 | | 1.14 | | |
| 554 | | 44.29 | | | | | 8.90 | |
| 555 | | 3.87 | 1.09 | 2.83 | | | 1.93 | |
| 556 | | | | 1.15 | | | | |
| 557 | | 6.31 | | | | | 1.79 | |
| 558 | | 139.72 | | | | | 28.48 | |
| 559 | | 1.41 | | 1.00 | | | 1.06 | |
| 560 | | | | 1.18 | | | | |
| 561 | | 141.25 | | | | | 56.86 | |
| 562 | | 25.48 | 13.18 | 2.20 | | | 5.98 | |
| 563 | | | | 153.89 | | | | |
| 564 | | | | 124.07 | | | | |
| 565 | | 1.34 | | | | | 1.19 | |
| 566 | | | | 1.04 | | | | |
| 567 | | 2.11 | | | | | 1.24 | |
| 568 | | 1.13 | | | | | 1.06 | |
| 569 | | | | 5.63 | | | | |
| 570 | | 74.58 | | | | | 28.89 | |
| 571 | | | | 1.15 | | | | |
| 572 | | 0.94 | | 141.13 | | | 1.11 | |
| 573 | | 0.93 | | 12.07 | | | 0.96 | |
| 574 | | 1.18 | | | | | 1.09 | |
| 575 | | 631.60 | | | | | 159.82 | |
| 576 | | | | 19.42 | | | | |
| 577 | | 0.88 | | | | | 0.92 | |
| 579 | | 1.01 | | | | | 1.07 | |
| 580 | | | | 1.13 | | | | |
| 581 | | | | 1.07 | | | | |
| 582 | | | | 1.09 | | | | |
| 583 | | | | 254.57 | | | | |
| 584 | | 1.11 | | | | | 1.12 | |

TABLE 1-5-continued

Cross-reactivity with WIV1

| Antibody ID | A | B | C | D | E | F | G | H |
|---|---|---|---|---|---|---|---|---|
| 585 | | 1.03 | | | | | 1.07 | |
| 586 | | | | 1.36 | | | | |
| 587 | | 2.28 | | | | | 1.21 | |
| 588 | | | | 1.28 | | | | |

TABLE 1-6

Binding to SARS-CoV-2 proteins and Spike variants

| Antibody ID | A | B | C | D | E | F | G |
|---|---|---|---|---|---|---|---|
| 555 | 1109.97 | 10.14 | 10.14 | 10.14 | 10.14 | 1162.05 | 1119.40 |
| 851 | 756.52 | 173.80 | 173.80 | 173.80 | 173.80 | 827.02 | 851.50 |
| 894 | 831.42 | 424.30 | 424.30 | 424.30 | 424.30 | 1104.35 | 1033.80 |
| 896 | 907.26 | | | | | 581.80 | |
| 923 | 1165.22 | 1.20 | 1.20 | 1.20 | 1.20 | 841.50 | 875.50 |
| 936 | 944.18 | | | | | 599.52 | |
| 970 | 860.95 | | | | | 525.79 | |
| 1015 | 1152.43 | | | | | 608.74 | |
| 1036 | 1371.06 | | | | | 598.98 | |
| 1037 | 1254.29 | 1.20 | 1.20 | 1.20 | 1.20 | 1045.45 | 1090.40 |
| 1075 | 1164.16 | 332.90 | 332.90 | 332.90 | 332.90 | 891.68 | 1008.90 |
| 1135 | 1042.45 | | | | | 553.37 | |
| 1139 | 1127.75 | | | | | 530.89 | |
| 1149 | 1069.61 | | | | | 571.33 | |
| 1404 | 1328.73 | 1.10 | 1.10 | 1.10 | 1.10 | 1181.55 | 1097.40 |
| 1444 | 1185.01 | 1.10 | 1.10 | 1.10 | 1.10 | 1039.15 | 936.80 |
| 1495 | 1234.61 | 279.90 | 279.90 | 279.90 | 279.90 | 1095.45 | 981.00 |
| 1538 | 1306.85 | 253.20 | 253.20 | 253.20 | 253.20 | 1081.55 | 982.80 |
| 1585 | 1011.95 | | | | | | |

| Antibody ID | H | I | J | K | L | M |
|---|---|---|---|---|---|---|
| 555 | 792.70 | 852.30 | 1013.10 | 610.40 | 182.78 | 776.1 |
| 851 | 849.90 | 772.30 | 772.80 | 452.30 | 681.24 | 544.6 |
| 894 | 975.70 | 934.10 | 931.10 | 547.30 | 878.94 | 96.4 |
| 896 | | | | | 946.25 | 691.8 |
| 923 | 858.80 | 845.60 | 787.20 | 531.00 | 435.20 | 604.0 |
| 936 | | | | | | |
| 970 | | | | | 791.08 | 633.1 |
| 1015 | | | | | | |
| 1036 | | | | | | |
| 1037 | 1069.40 | 1044.70 | 999.90 | 632.00 | 984.96 | 749.1 |
| 1075 | 950.90 | 899.10 | 898.90 | 520.20 | 750.46 | 33.1 |
| 1135 | | | | | | |
| 1139 | | | | | | |
| 1149 | | | | | | |
| 1404 | 1050.40 | 1042.90 | 978.80 | 612.30 | 941.38 | 719.3 |
| 1444 | 896.10 | 867.00 | 826.50 | 530.10 | 801.64 | 626.0 |
| 1495 | 938.40 | 932.60 | 880.20 | 561.10 | 927.74 | 707.8 |
| 1538 | 930.10 | 919.30 | 868.10 | 545.80 | 928.15 | 706.3 |
| 1585 | | | | | | |

TABLE 1-7

Binding to other coronavirus proteins

| Antibody ID | A | B | C | D | E |
|---|---|---|---|---|---|
| 555 | 1.01 | 1.02 | 1.02 | 2.77 | 1.07 |
| 851 | 1.16 | 1.12 | 1.07 | 2.80 | 1.30 |
| 894 | 1.18 | 1.06 | 1.10 | 3.17 | 1.23 |
| 896 | 1.07 | 1.02 | 0.97 | 2.34 | 0.97 |
| 923 | 1.42 | 1.08 | 772.71 | 973.84 | 1.09 |
| 936 | 1.02 | 0.92 | 0.95 | 1.90 | 1.06 |
| 970 | 0.88 | 0.87 | 547.11 | 590.08 | 1.67 |
| 1015 | 1.04 | 0.85 | 0.91 | 1.64 | 1.19 |
| 1036 | 0.94 | 1.07 | 1.05 | 2.33 | 1.24 |
| 1037 | 1.43 | 1.06 | 4.36 | 7.79 | 1.03 |
| 1075 | 0.93 | 0.89 | 0.91 | 1.41 | 1.06 |
| 1135 | 0.83 | 0.93 | 0.92 | 2.85 | 1.04 |
| 1139 | 0.94 | 0.99 | 1.03 | 1.97 | 0.93 |
| 1149 | 0.83 | 1.04 | 1.05 | 2.67 | 1.17 |
| 1404 | 0.94 | 0.91 | 0.97 | 3.55 | 1.10 |
| 1444 | 0.98 | 0.98 | 1.03 | 4.68 | 0.99 |
| 1495 | 1.05 | 0.93 | 1.08 | 4.80 | 1.00 |
| 1538 | 0.97 | 0.95 | 0.99 | 2.71 | 0.97 |
| 1585 | 0.88 | 0.94 | 25.81 | 85.14 | 0.95 |

TABLE 1-8

Binding to SARS-CoV-2 NTD variant cells

| Antibody ID | A | B | C | D | E | F | G |
|---|---|---|---|---|---|---|---|
| 555 | 145.70 | 146.49 | 154.09 | 28.93 | 8.15 | 138.80 | 22.22 |
| 851 | 151.90 | 129.00 | 154.52 | 23.12 | 33.08 | 121.71 | 34.05 |
| 894 | 155.60 | 163.00 | 175.15 | | | 156.90 | |
| 896 | 150.60 | 143.71 | 154.66 | 24.89 | 22.67 | 143.38 | 34.64 |
| 923 | 84.20 | 116.82 | 124.35 | 22.24 | 40.36 | 103.22 | 30.86 |
| 936 | | | | 20.24 | 21.94 | | 30.71 |
| 970 | 28.50 | | | 13.25 | 13.73 | | 17.18 |
| 1015 | 21.50 | | 12.11 | 7.93 | | 15.47 | |
| 1036 | | | | 7.62 | 5.28 | | 8.11 |
| 1037 | 110.40 | 147.65 | 164.57 | 26.43 | 38.10 | 138.69 | 44.45 |
| 1075 | 127.10 | 169.91 | 181.91 | 24.46 | 35.39 | 155.16 | 38.12 |
| 1135 | | | | 8.04 | 5.82 | | 8.91 |
| 1139 | | | | 13.45 | 5.72 | | 16.20 |
| 1149 | | | | 13.72 | 6.52 | | 16.54 |
| 1404 | 124.70 | 156.50 | 172.39 | 53.77 | | 146.84 | |
| 1444 | 49.10 | 66.26 | 70.93 | 53.09 | | 65.19 | |
| 1495 | 98.80 | 114.41 | 147.65 | 42.26 | | 103.80 | |
| 1538 | 103.10 | 140.69 | 153.16 | 49.93 | | 130.02 | |
| 1585 | 7.70 | | | 8.89 | | | |

TABLE 1-9

Binding to SARS-CoV-2 RBD variant cells

| Antibody ID | A | B | C | D | E | F |
|---|---|---|---|---|---|---|
| 555 | 23.35 | 171.76 | 60.60 | 60.22 | 172.20 | 46.06 |
| 851 | 11.30 | 144.28 | 74.70 | 23.73 | 160.10 | 40.78 |
| 894 | | 169.02 | 86.50 | 27.10 | 197.50 | 38.38 |
| 896 | 11.88 | 176.17 | 80.20 | 24.65 | 202.80 | 40.95 |
| 923 | 9.36 | 135.75 | 75.20 | 21.58 | 75.30 | 52.73 |
| 936 | 10.25 | | | 18.56 | | |
| 970 | 4.24 | 45.83 | 12.50 | 16.23 | 30.90 | 34.97 |
| 1015 | 4.53 | | 19.90 | 22.08 | 23.80 | 31.38 |
| 1036 | 3.49 | | | 10.56 | | |

TABLE 1-9-continued

Binding to SARS-CoV-2 RBD variant cells

| 1037 | 13.96 | 170.49 | 92.10 | 34.16 | 90.00  | 71.24 |
| 1075 | 12.43 | 168.44 | 96.40 | 41.20 | 122.00 | 49.07 |
| 1135 | 3.68  |        |       | 11.59 |        |       |
| 1139 | 4.72  |        |       | 20.17 |        |       |
| 1149 | 5.01  |        |       | 21.25 |        |       |
| 1404 |       | 183.58 | 102.70| 64.37 | 106.00 | 54.42 |
| 1444 |       | 90.53  | 40.10 | 60.40 | 38.60  | 49.49 |
| 1495 |       | 98.65  | 84.20 | 42.21 | 76.90  | 42.88 |
| 1538 |       | 127.13 | 93.10 | 53.02 | 97.10  | 49.54 |
| 1585 |       |        | 5.80  | 11.49 | 4.40   | 6.44  |

| Antibody ID | G | H | I | J | K | L |
|---|---|---|---|---|---|---|
| 555  | 27.41 | 148.69 | 116.90 | 83.02 | 238.19 | 65.04 |
| 851  | 21.72 | 222.91 | 226.17 | 62.71 | 171.25 | 46.10 |
| 894  |       | 269.23 | 272.21 | 86.41 | 230.13 | 62.05 |
| 896  | 22.67 | 267.57 | 268.60 | 84.64 | 239.19 | 61.24 |
| 923  | 21.68 | 185.71 | 201.07 | 61.12 | 155.69 | 54.80 |
| 936  | 17.84 |        |        |       |        |       |
| 970  | 11.22 | 46.01  | 51.56  | 23.22 |        |       |
| 1015 | 11.46 |        |        |       |        |       |
| 1036 | 6.16  |        |        |       |        |       |
| 1037 | 24.26 | 269.81 | 258.52 | 85.98 | 231.73 | 64.27 |
| 1075 | 24.29 | 284.22 | 298.74 | 91.82 | 245.01 | 64.92 |
| 1135 | 6.56  |        |        |       |        |       |
| 1139 | 9.24  |        |        |       |        |       |
| 1149 | 11.25 |        |        |       |        |       |
| 1404 | 32.35 | 266.89 | 279.65 | 91.39 | 242.79 | 69.86 |
| 1444 | 42.63 | 116.14 | 120.00 | 41.74 | 119.53 | 56.06 |
| 1495 | 33.31 | 206.12 | 209.78 | 53.94 | 159.53 | 43.45 |
| 1538 | 38.96 | 255.77 | 267.12 | 64.08 | 203.08 | 52.91 |
| 1585 | 8.29  |        |        |       |        |       |

TABLE 1-10

Binding to other coronavirus proteins

| Antibody ID | A | B | C | D | E | F |
|---|---|---|---|---|---|---|
| 555  | 40.44 | 127.49 | 27.41 | 4.40   | 0.66   | 0.84 |
| 851  | 60.00 | 138.39 | 21.72 | 90.38  | 0.62   | 0.77 |
| 894  | 77.71 | 174.87 |       | 111.81 | 0.67   | 0.86 |
| 896  | 70.26 | 172.80 | 22.67 | 95.91  | 0.69   | 0.83 |
| 923  | 58.97 | 133.81 | 21.68 | 23.39  | 117.81 | 1.04 |
| 936  | 33.14 | 89.38  | 17.84 | N/A    | N/A    | 1.13 |
| 970  | 20.59 | 43.27  | 11.22 | 18.40  | 124.13 | 0.97 |
| 1015 | 30.48 | 41.71  | 11.46 | N/A    | 0.89   | 1.00 |
| 1036 | 10.17 | 25.04  | 6.16  | N/A    | N/A    | 1.22 |
| 1037 | 82.95 | 167.03 | 24.26 | 102.78 | 23.11  | 1.26 |
| 1075 | 78.74 | 185.56 | 24.29 | 109.71 | 0.86   | 1.02 |
| 1135 | 10.86 | 29.39  | 6.56  | N/A    | N/A    | 1.10 |
| 1139 | 20.29 | 40.96  | 9.24  | N/A    | N/A    | 1.06 |
| 1149 | 19.23 | 56.88  | 11.25 | N/A    | N/A    | 1.12 |
| 1404 | 71.21 | 171.75 | 32.35 | 103.34 | 0.86   | 1.06 |
| 1444 | 48.74 | 89.18  | 42.63 | 48.74  | 0.77   | 0.98 |
| 1495 | 57.32 | 122.64 | 33.31 | 76.24  | 0.72   | 0.87 |
| 1538 | 67.45 | 156.58 | 38.96 | 93.38  | 0.75   | 0.88 |
| 1585 | 9.55  | 6.90   | 8.29  | N/A    | 19.90  | 1.02 |

Example 2

Expression and Purification of Antibodies

Antibodies were expressed and purified essentially as follows. An appropriate host cell, such as HEK 293 or CHO, was either transiently or stably transfected with an expression system for secreting antibodies using an optimal predetermined HC:LC vector ratio (such as 1:3 or 1:2) or a single vector system encoding both the HC and the LC. Clarified media, into which the antibody had been secreted, was purified using any of many commonly-used techniques. For example, the medium may be conveniently applied to a MABSELECT® column (GE Healthcare), or KappaSelect column (GE Healthcare) for Fab fragment, that has been equilibrated with a compatible buffer, such as phosphate buffered saline (pH 7.4).

The column was washed to remove nonspecific binding components. The bound antibody was eluted, for example, by pH gradient (such as 20 mM Tris buffer, pH 7.0 to 10 mM sodium citrate buffer, pH 3.0, or phosphate buffered saline pH 7.4 to 100 mM glycine buffer, pH 3.0). Antibody fractions were detected, such as by SDS-PAGE, and then were pooled. Further purification was deemed optional, depending on intended use.

Populations of each antibody were concentrated and/or sterile filtered using common techniques. Soluble aggregate and multimers are effectively removed by common techniques, including size exclusion, hydrophobic interaction, ion exchange, multimodal, or hydroxyapatite chromatography. The purity of the antibody after these chromatography steps was between about 95% to about 99%. The product was either refrigerated, immediately frozen at −70° C., or was lyophilized.

Various physical and expression-related characteristics particular exemplary antibodies were determined using methodologies known in the art (see Tables 2-1 through 2-5 below).

Antibody encoding plasmid DNA was transfected into Expi293-F™ cells (GIBCO) to produce antibodies using the manufacturer's recommended protocol with some modifications. Expi293-F™ cells were aliquoted into 24 well plates and incubated with shaking at 37° C. with 8% $CO_2$ and 85% humidity. Heavy and light chain plasmids were pooled at a 1:1 heavy to light chain mass, mixed with Expi293Fectamine, and added dropwise to cells in each well. Expi293F Enhancer I and II were added 20 hr post-transfection and cell supernatants were harvested 4 d post transfection. Antibody titers were measured by biolayer interferometry on an Octet HTX instrument (ForteBio). See Table 2-1. Expression volume was 4 mL.

TABLE 2-1

Expression levels (N = 2) of monoclonal antibodies in expiHEK293 cells.

| Antibody ID | Expression level (μg/mL) replica 1 | Expression amount (μg) replica 1 | Expression level (μg/mL) replica 2 | Expression amount (μg) replica 2 | Average expression level (μg/mL) ± SD | Average expression amount (μg) ± SD |
|---|---|---|---|---|---|---|
| 258 | 108.8 | 391.7 | 135.5 | 487.8 | 122.2 ± 13.3 | 439.8 ± 48 |
| 261 | 181.6 | 653.8 | 189.4 | 681.8 | 185.5 ± 3.9 | 667.8 ± 14 |
| 262 | 86    | 309.6 | 104.2 | 375.1 | 95.1 ± 9.1   | 342.4 ± 32.8 |
| 268 | 25.9  | 93.2  | 24.6  | 88.6  | 25.3 ± 0.6   | 90.9 ± 2.3 |

TABLE 2-1-continued

Expression levels (N = 2) of monoclonal antibodies in expiHEK293 cells.

| Antibody ID | Expression level (μg/mL) replica 1 | Expression amount (μg) replica 1 | Expression level (μg/mL) replica 2 | Expression amount (μg) replica 2 | Average expression level (μg/mL) ± SD | Average expression amount (μg) ± SD |
|---|---|---|---|---|---|---|
| 269 | 90.1 | 324.4 | 105.7 | 380.5 | 97.9 ± 7.8 | 352.5 ± 28.1 |
| 272 | 19.1 | 68.8 | 19.5 | 70.2 | 19.3 ± 0.2 | 69.5 ± 0.7 |
| 274 | 100.4 | 361.4 | 104.1 | 374.8 | 102.3 ± 1.8 | 368.1 ± 6.7 |
| 275 | 196.3 | 706.7 | 223.5 | 804.6 | 209.9 ± 13.6 | 755.7 ± 49 |
| 277 | 51 | 183.6 | 73.3 | 263.9 | 62.2 ± 11.2 | 223.8 ± 40.1 |
| 278 | 90.8 | 326.9 | 97 | 349.2 | 93.9 ± 3.1 | 338.1 ± 11.2 |
| 279 | 81.5 | 293.4 | 90.5 | 325.8 | 86 ± 4.5 | 309.6 ± 16.2 |
| 280 | 21.6 | 77.8 | 22 | 79.2 | 21.8 ± 0.2 | 78.5 ± 0.7 |
| 283 | 57.3 | 206.3 | 60.6 | 218.2 | 59 ± 1.7 | 212.3 ± 5.9 |
| 285 | 132.4 | 476.6 | 145.6 | 524.2 | 139 ± 6.6 | 500.4 ± 23.8 |
| 286 | 28 | 100.8 | 31.4 | 113 | 29.7 ± 1.7 | 106.9 ± 6.1 |
| 287 | 67.2 | 241.9 | 68.7 | 247.3 | 68 ± 0.8 | 244.6 ± 2.7 |
| 291 | 375.3 | 1351.1 | 461.8 | 1662.5 | 418.6 ± 3.3 | 1506.8 ± 155.7 |
| 292 | 217.1 | 781.6 | 229.7 | 826.9 | 223.4 ± 6.3 | 804.3 ± 22.7 |
| 296 | 95.7 | 344.5 | 90.1 | 324.4 | 92.9 ± 2.8 | 334.5 ± 10.1 |
| 297 | 40 | 144 | 39.1 | 140.8 | 39.6 ± 0.4 | 142.4 ± 1.6 |
| 298 | 59.1 | 212.8 | 78.5 | 282.6 | 68.8 ± 9.7 | 247.7 ± 34.9 |
| 302 | 52.2 | 187.9 | 58.8 | 211.7 | 55.5 ± 3.3 | 199.8 ± 11.9 |
| 304 | 123.1 | 443.2 | 127.8 | 460.1 | 125.5 ± 2.4 | 451.7 ± 8.5 |
| 305 | 79.2 | 285.1 | 91.6 | 329.8 | 85.4 ± 6.2 | 307.5 ± 22.4 |
| 307 | 44.8 | 161.3 | 46.7 | 168.1 | 45.8 ± 1 | 164.7 ± 3.4 |
| 308 | 134.9 | 485.6 | 139.4 | 501.8 | 137.2 ± 2.3 | 493.7 ± 8.1 |
| 309 | 143.9 | 518 | 164.1 | 590.8 | 154 ± 10.1 | 554.4 ± 36.4 |
| 310 | 118.4 | 426.2 | 113.7 | 409.3 | 116.1 ± 2.4 | 417.8 ± 8.4 |
| 311 | 105.7 | 380.5 | 120.8 | 434.9 | 113.3 ± 7.6 | 407.7 ± 27.2 |
| 312 | 44.6 | 160.6 | 53.8 | 193.7 | 49.2 ± 4.6 | 177.2 ± 16.6 |
| 313 | 142.2 | 511.9 | 200.6 | 722.2 | 171.4 ± 29.2 | 617.1 ± 105.2 |
| 314 | 2.6 | 9.5 | 2.9 | 10.3 | 2.8 ± 0.2 | 9.9 ± 0.4 |
| 318 | 59.8 | 215.3 | 61.6 | 221.8 | 60.7 ± 0.9 | 218.6 ± 3.3 |
| 321 | 11.9 | 42.8 | 12.7 | 45.7 | 12.3 ± 0.4 | 44.3 ± 1.5 |
| 322 | 164.6 | 592.6 | 176.8 | 636.5 | 170.7 ± 6.1 | 614.6 ± 22 |
| 325 | 119 | 428.4 | 125.3 | 451.1 | 122.2 ± 3.2 | 439.8 ± 11.4 |
| 330 | 139.6 | 502.6 | 135.1 | 486.4 | 137.4 ± 2.3 | 494.5 ± 8.1 |
| 334 | 36 | 129.6 | 38.6 | 139 | 37.3 ± 1.3 | 134.3 ± 4.7 |
| 335 | 1.4 | 5.1 | 1.4 | 5.1 | 1.4 ± 0 | 5.1 ± 0 |
| 336 | 45.8 | 164.9 | 49 | 176.4 | 47.4 ± 1.6 | 170.7 ± 5.8 |
| 338 | 87.4 | 314.6 | 110.9 | 399.2 | 99.2 ± 11.8 | 356.9 ± 42.3 |
| 341 | 8 | 28.7 | 8.5 | 30.6 | 8.3 ± 0.3 | 29.7 ± 1 |
| 346 | 31.8 | 114.5 | 33.4 | 120.2 | 32.6 ± 0.8 | 117.4 ± 2.9 |
| 350 | 75.4 | 271.4 | 99.4 | 357.8 | 87.4 ± 12 | 314.6 ± 43.2 |
| 352 | 72.3 | 260.3 | 72.5 | 261 | 72.4 ± 0.1 | 260.7 ± 0.3 |
| 353 | 144 | 518.4 | 130.8 | 470.9 | 137.4 ± 6.6 | 494.7 ± 23.8 |
| 354 | 70.4 | 253.4 | 67.3 | 242.3 | 68.9 ± 1.6 | 247.9 ± 5.6 |
| 355 | 8.8 | 31.8 | 8.7 | 31.3 | 8.8 ± 0.1 | 31.6 ± 0.3 |
| 356 | 88.9 | 320 | 102.8 | 370.1 | 95.9 ± 7 | 345.1 ± 25.1 |
| 357 | 193.8 | 697.7 | 198.3 | 713.9 | 196.1 ± 2.3 | 705.8 ± 8.1 |
| 358 | 136.7 | 492.1 | 159 | 572.4 | 147.9 ± 11.2 | 532.3 ± 40.2 |
| 359 | 196.5 | 707.4 | 201.4 | 725 | 199 ± 2.5 | 716.2 ± 8.8 |
| 360 | 126.6 | 455.8 | 146.4 | 527 | 136.5 ± 9.9 | 491.4 ± 35.6 |
| 361 | 70.6 | 254.2 | 72.3 | 260.3 | 71.5 ± 0.9 | 257.3 ± 3.1 |
| 364 | 29.1 | 104.8 | 31.3 | 112.7 | 30.2 ± 1.1 | 108.8 ± 4 |
| 368 | 67 | 241.2 | 68.6 | 247 | 67.8 ± 0.8 | 244.1 ± 2.9 |
| 369 | 84.9 | 305.6 | 99.6 | 358.6 | 92.3 ± 7.3 | 332.1 ± 26.5 |
| 370 | 56.3 | 202.7 | 71 | 255.6 | 63.7 ± 7.3 | 229.2 ± 26.5 |
| 371 | 89.2 | 321.1 | 104.5 | 376.2 | 96.9 ± 7.7 | 348.7 ± 27.6 |
| 373 | 56.4 | 203 | 70.6 | 254.2 | 63.5 ± 7.1 | 228.6 ± 25.6 |
| 374 | 111 | 399.6 | 125.3 | 451.1 | 118.2 ± 7.2 | 425.4 ± 25.8 |
| 377 | 108.1 | 389.2 | 133.1 | 479.2 | 120.6 ± 12.5 | 434.2 ± 45 |
| 381 | 142 | 511.2 | 151.9 | 546.8 | 147 ± 5 | 529 ± 17.8 |
| 382 | 44.8 | 161.3 | 46.9 | 168.8 | 45.9 ± 1.1 | 165.1 ± 3.8 |
| 383 | 49.6 | 178.6 | 51.2 | 184.3 | 50.4 ± 0.8 | 181.5 ± 2.9 |
| 384 | 33.5 | 120.6 | 35.7 | 128.5 | 34.6 ± 1.1 | 124.6 ± 4 |
| 386 | 2 | 7.1 | 2.2 | 7.7 | 2.1 ± 0.1 | 7.4 ± 0.3 |
| 387 | 66.6 | 239.8 | 84.9 | 305.6 | 75.8 ± 9.1 | 272.7 ± 32.9 |
| 388 | 136.1 | 490 | 158 | 568.8 | 147.1 ± 11 | 529.4 ± 39.4 |
| 389 | 62.7 | 225.7 | 58.7 | 211.3 | 60.7 ± 2 | 218.5 ± 7.2 |
| 390 | 116.8 | 420.5 | 112.7 | 405.7 | 114.8 ± 2.1 | 413.1 ± 7.4 |
| 391 | 50.9 | 183.2 | 51.6 | 185.8 | 51.3 ± 0.4 | 184.5 ± 1.3 |
| 393 | 202.8 | 730.1 | 197.7 | 711.9 | 200.3 ± 2.6 | 720.9 ± 9.2 |
| 394 | 79.5 | 286.2 | 80.3 | 289.1 | 79.9 ± 0.4 | 287.7 ± 1.5 |
| 397 | 64.4 | 231.8 | 87.1 | 313.6 | 75.8 ± 11.4 | 272.7 ± 40.9 |
| 399 | 131.9 | 474.8 | 180.1 | 648.4 | 156 ± 24.1 | 561.6 ± 86.8 |
| 400 | 320.9 | 1155.2 | 383.2 | 1379.5 | 352.1 ± 31.2 | 1267.4 ± 112.2 |
| 401 | 19.8 | 71.3 | 24.1 | 86.8 | 22 ± 2.2 | 79.1 ± 7.8 |

TABLE 2-1-continued

Expression levels (N = 2) of monoclonal antibodies in expiHEK293 cells.

| Antibody ID | Expression level (µg/mL) replica 1 | Expression amount (µg) replica 1 | Expression level (µg/mL) replica 2 | Expression amount (µg) replica 2 | Average expression level (µg/mL) ± SD | Average expression amount (µg) ± SD |
|---|---|---|---|---|---|---|
| 402 | 46.9 | 168.8 | 55 | 198 | 51 ± 4.1 | 183.4 ± 14.6 |
| 403 | 173.2 | 623.5 | 172.3 | 620.3 | 172.8 ± 0.4 | 621.9 ± 1.6 |
| 404 | 26.6 | 95.8 | 29.6 | 106.6 | 28.1 ± 1.5 | 101.2 ± 5.4 |
| 408 | 93.8 | 337.7 | 101.6 | 365.8 | 97.7 ± 3.9 | 351.8 ± 14.1 |
| 410 | 118.8 | 427.7 | 131.7 | 474.1 | 125.3 ± 6.5 | 450.9 ± 23.2 |
| 411 | 1 | 3.7 | 1.2 | 4.2 | 1.1 ± 0.1 | 4 ± 0.3 |
| 413 | 149.9 | 539.6 | 134.5 | 484.2 | 142.2 ± 7.7 | 511.9 ± 27.7 |
| 414 | 59.7 | 214.9 | 67.8 | 244.1 | 63.8 ± 4.1 | 229.5 ± 14.6 |
| 415 | 192.2 | 691.9 | 200.2 | 720.7 | 196.2 ± 4 | 706.3 ± 14.4 |
| 417 | 78.5 | 282.6 | 84.3 | 303.5 | 81.4 ± 2.9 | 293.1 ± 10.5 |
| 419 | 75.9 | 273.2 | 76.7 | 276.1 | 76.3 ± 0.4 | 274.7 ± 1.5 |
| 420 | 3.1 | 11.2 | 3.3 | 11.8 | 3.2 ± 0.1 | 11.5 ± 0.3 |
| 426 | 1.8 | 6.5 | 1.9 | 6.7 | 1.9 ± 0 | 6.6 ± 0.1 |
| 428 | 57 | 205.2 | 64 | 230.4 | 60.5 ± 3.5 | 217.8 ± 12.6 |
| 429 | 90.7 | 326.5 | 100.6 | 362.2 | 95.7 ± 5 | 344.4 ± 17.9 |
| 430 | 19.6 | 70.6 | 19.5 | 70.2 | 19.6 ± 0.1 | 70.4 ± 0.2 |
| 432 | 16 | 57.6 | 16.6 | 59.8 | 16.3 ± 0.3 | 58.7 ± 1.1 |
| 433 | 383.4 | 1380.2 | 426.2 | 1534.3 | 404.8 ± 21.4 | 1457.3 ± 77.1 |
| 436 | 54.7 | 196.9 | 63.5 | 228.6 | 59.1 ± 4.4 | 212.8 ± 15.9 |
| 438 | 11.3 | 40.7 | 12.1 | 43.6 | 11.7 ± 0.4 | 42.2 ± 1.5 |
| 440 | 74.1 | 266.8 | 81.2 | 292.3 | 77.7 ± 3.6 | 279.6 ± 12.8 |
| 441 | 168.6 | 607 | 165.3 | 595.1 | 167 ± 1.6 | 601.1 ± 5.9 |
| 442 | 126.1 | 454 | 143.3 | 515.9 | 134.7 ± 8.6 | 485 ± 31 |
| 444 | 54.6 | 196.6 | 60.5 | 217.8 | 57.6 ± 3 | 207.2 ± 10.6 |
| 445 | 105.7 | 380.5 | 115.4 | 415.4 | 110.6 ± 4.9 | 398 ± 17.5 |
| 447 | 113.9 | 410 | 126.5 | 455.4 | 120.2 ± 6.3 | 432.7 ± 22.7 |
| 448 | 72.5 | 261 | 85.4 | 307.4 | 79 ± 6.5 | 284.2 ± 23.2 |
| 449 | 139 | 500.4 | 193.4 | 696.2 | 166.2 ± 27.2 | 598.3 ± 97.9 |
| 450 | 7.1 | 25.6 | 7.6 | 27.4 | 7.4 ± 0.3 | 26.5 ± 0.9 |
| 451 | 150.1 | 540.4 | 155 | 558 | 152.6 ± 2.5 | 549.2 ± 8.8 |
| 453 | 117.9 | 424.4 | 109 | 392.4 | 113.5 ± 4.5 | 408.4 ± 16 |
| 455 | 123.9 | 446 | 156.7 | 564.1 | 140.3 ± 16.4 | 505.1 ± 59.1 |
| 457 | 1.1 | 3.9 | 1.3 | 4.5 | 1.2 ± 0.1 | 4.2 ± 0.3 |
| 458 | 157.9 | 568.4 | 160.7 | 578.5 | 159.3 ± 1.4 | 573.5 ± 5.1 |
| 459 | 68.9 | 248 | 87.8 | 316.1 | 78.4 ± 9.5 | 282.1 ± 34.1 |
| 460 | 140.6 | 506.2 | 142.6 | 513.4 | 141.6 ± 1 | 509.8 ± 3.6 |
| 461 | 62.6 | 225.4 | 81.4 | 293 | 72 ± 9.4 | 259.2 ± 33.8 |
| 462 | 44.2 | 159.1 | 53.1 | 191.2 | 48.7 ± 4.5 | 175.2 ± 16.1 |
| 463 | 143.7 | 517.3 | 156.9 | 564.8 | 150.3 ± 6.6 | 541.1 ± 23.8 |
| 464 | 115 | 414 | 131.6 | 473.8 | 123.3 ± 8.3 | 443.9 ± 29.9 |
| 465 | 105 | 378 | 146 | 525.6 | 125.5 ± 20.5 | 451.8 ± 73.8 |
| 466 | 1.5 | 5.3 | 1.7 | 6.1 | 1.6 ± 0.1 | 5.7 ± 0.4 |
| 467 | 142.1 | 511.6 | 166.2 | 598.3 | 154.2 ± 12.1 | 555 ± 43.4 |
| 468 | 169.2 | 609.1 | 160.8 | 578.9 | 165 ± 4.2 | 594 ± 15.1 |
| 469 | 49.2 | 177.1 | 54.2 | 195.1 | 51.7 ± 2.5 | 186.1 ± 9 |
| 472 | 107.1 | 385.6 | 106.1 | 382 | 106.6 ± 0.5 | 383.8 ± 1.8 |
| 473 | 203.9 | 734 | 237.7 | 855.7 | 220.8 ± 16.9 | 794.9 ± 60.9 |
| 478 | 325.5 | 1171.8 | 291.4 | 1049 | 308.5 ± 17.1 | 1110.4 ± 61.4 |
| 479 | 93.3 | 335.9 | 101.6 | 365.8 | 97.5 ± 4.2 | 350.9 ± 15 |
| 481 | 58.2 | 209.5 | 73.3 | 263.9 | 65.8 ± 7.5 | 236.7 ± 27.2 |
| 482 | 33 | 118.8 | 32.7 | 117.7 | 32.9 ± 0.1 | 118.3 ± 0.5 |
| 483 | 81.1 | 292 | 76.3 | 274.7 | 78.7 ± 2.4 | 283.4 ± 8.7 |
| 484 | 28.8 | 103.7 | 27.4 | 98.6 | 28.1 ± 0.7 | 101.2 ± 2.6 |
| 486 | 246.9 | 888.8 | 292.5 | 1053 | 269.7 ± 22.8 | 970.9 ± 82.1 |
| 488 | 53.3 | 191.9 | 53.2 | 191.5 | 53.3 ± 0 | 191.7 ± 0.2 |
| 489 | 91.4 | 329 | 105.6 | 380.2 | 98.5 ± 7.1 | 354.6 ± 25.6 |
| 490 | 0 | 0 | 0.4 | 1.3 | 0.2 ± 0.2 | 0.7 ± 0.7 |
| 491 | 272.9 | 982.4 | 284.7 | 1024.9 | 278.8 ± 5.9 | 1003.7 ± 21.3 |
| 493 | 97.9 | 352.4 | 135.5 | 487.8 | 116.7 ± 18.8 | 420.1 ± 67.7 |
| 494 | 22.8 | 82.1 | 20.3 | 73.1 | 21.6 ± 1.3 | 77.6 ± 4.5 |
| 495 | 85.2 | 306.7 | 123.8 | 445.5 | 104.5 ± 19.3 | 376.2 ± 69.5 |
| 499 | 95.2 | 342.7 | 111 | 399.6 | 103.1 ± 7.9 | 371.2 ± 28.5 |
| 500 | 65.8 | 236.9 | 72.6 | 261.4 | 69.2 ± 3.4 | 249.2 ± 12.3 |
| 501 | 122.4 | 440.6 | 170.5 | 613.8 | 146.5 ± 24.1 | 527.2 ± 86.6 |
| 502 | 38.7 | 139.3 | 47.5 | 171 | 43.1 ± 4.4 | 155.2 ± 15.9 |
| 503 | 67.7 | 243.7 | 61.4 | 221 | 64.6 ± 3.2 | 232.4 ± 11.4 |
| 506 | 134.7 | 484.9 | 143.8 | 517.7 | 139.3 ± 4.6 | 501.3 ± 16.4 |
| 508 | 53.1 | 191.2 | 55.8 | 200.9 | 54.5 ± 1.4 | 196.1 ± 4.9 |
| 511 | 65.2 | 234.7 | 66 | 237.6 | 65.6 ± 0.4 | 236.2 ± 1.5 |
| 513 | 217.7 | 783.7 | 245.4 | 883.4 | 231.6 ± 13.9 | 833.6 ± 49.9 |
| 515 | 56.9 | 204.8 | 60.7 | 218.5 | 58.8 ± 1.9 | 211.7 ± 6.8 |
| 518 | 95.3 | 343.1 | 110.3 | 397.1 | 102.8 ± 7.5 | 370.1 ± 27 |
| 519 | 288.1 | 1037.2 | 247.5 | 891 | 267.8 ± 20.3 | 964.1 ± 73.1 |
| 520 | 89.7 | 322.9 | 133.3 | 479.9 | 111.5 ± 21.8 | 401.4 ± 78.5 |

TABLE 2-1-continued

Expression levels (N = 2) of monoclonal antibodies in expiHEK293 cells.

| Antibody ID | Expression level (μg/mL) replica 1 | Expression amount (μg) replica 1 | Expression level (μg/mL) replica 2 | Expression amount (μg) replica 2 | Average expression level (μg/mL) ± SD | Average expression amount (μg) ± SD |
|---|---|---|---|---|---|---|
| 521 | 64.9 | 233.6 | 61.4 | 221 | 63.2 ± 1.8 | 227.3 ± 6.3 |
| 524 | 140.4 | 505.4 | 206.4 | 743 | 173.4 ± 33 | 624.2 ± 118.8 |
| 525 | 137.7 | 495.7 | 127.5 | 459 | 132.6 ± 5.1 | 477.4 ± 18.4 |
| 526 | 83.9 | 302 | 78.1 | 281.2 | 81 ± 2.9 | 291.6 ± 10.4 |
| 528 | 84.5 | 304.2 | 85.8 | 308.9 | 85.2 ± 0.6 | 306.6 ± 2.3 |
| 529 | 2.4 | 8.8 | 2.6 | 9.2 | 2.5 ± 0.1 | 9 ± 0.2 |
| 530 | 69.8 | 251.3 | 70.3 | 253.1 | 70.1 ± 0.3 | 252.2 ± 0.9 |
| 532 | 23.5 | 84.6 | 25.1 | 90.4 | 24.3 ± 0.8 | 87.5 ± 2.9 |
| 534 | 115.3 | 415.1 | 113.8 | 409.7 | 114.6 ± 0.8 | 412.4 ± 2.7 |
| 535 | 154.9 | 557.6 | 170.1 | 612.4 | 162.5 ± 7.6 | 585 ± 27.4 |
| 539 | 104.5 | 376.2 | 98.7 | 355.3 | 101.6 ± 2.9 | 365.8 ± 10.5 |
| 540 | 61 | 219.6 | 71.9 | 258.8 | 66.5 ± 5.5 | 239.2 ± 19.6 |
| 549 | 35.1 | 126.4 | 36.4 | 131 | 35.8 ± 0.6 | 128.7 ± 2.3 |
| 552 | 113.8 | 409.7 | 113.3 | 407.9 | 113.6 ± 0.3 | 408.8 ± 0.9 |
| 553 | 3.9 | 14.2 | 3.8 | 13.7 | 3.9 ± 0.1 | 14 ± 0.3 |
| 554 | 163.7 | 589.3 | 179.8 | 647.3 | 171.8 ± 8.1 | 618.3 ± 29 |
| 555 | 21.6 | 77.8 | 20.9 | 75.2 | 21.3 ± 0.4 | 76.5 ± 1.3 |
| 557 | 336.9 | 1212.8 | 358.4 | 1290.2 | 347.7 ± 10.8 | 1251.5 ± 38.7 |
| 558 | 397.9 | 1432.4 | 397.9 | 1432.4 | 397.9 ± 0 | 1432.4 ± 0 |
| 559 | 226.6 | 815.8 | 236.7 | 852.1 | 231.7 ± 5.1 | 834 ± 18.2 |
| 561 | 262.2 | 943.9 | 275 | 990 | 268.6 ± 6.4 | 967 ± 23.1 |
| 562 | 163.6 | 589 | 166.4 | 599 | 165 ± 1.4 | 594 ± 5 |
| 565 | 46.8 | 168.5 | 46.5 | 167.4 | 46.7 ± 0.1 | 168 ± 0.5 |
| 567 | 92.7 | 333.7 | 108.2 | 389.5 | 100.5 ± 7.8 | 361.6 ± 27.9 |
| 568 | 53.6 | 193 | 63.6 | 229 | 58.6 ± 5 | 211 ± 18 |
| 570 | 99.7 | 358.9 | 101 | 363.6 | 100.4 ± 0.6 | 361.3 ± 2.4 |
| 572 | 1.4 | 4.9 | 1.6 | 5.6 | 1.5 ± 0.1 | 5.3 ± 0.4 |
| 573 | 39.4 | 141.8 | 40.9 | 147.2 | 40.2 ± 0.8 | 144.5 ± 2.7 |
| 574 | 149.8 | 539.3 | 189.3 | 681.5 | 169.6 ± 19.8 | 610.4 ± 71.1 |
| 575 | 98.9 | 356 | 104.8 | 377.3 | 101.9 ± 3 | 366.7 ± 10.7 |
| 577 | 65.6 | 236.2 | 59.8 | 215.3 | 62.7 ± 2.9 | 225.8 ± 10.5 |
| 579 | 29.5 | 106.2 | 29.9 | 107.6 | 29.7 ± 0.2 | 106.9 ± 0.7 |
| 584 | 57.9 | 208.4 | 62 | 223.2 | 60 ± 2.1 | 215.8 ± 7.4 |
| 585 | 99.2 | 357.1 | 111 | 399.6 | 105.1 ± 5.9 | 378.4 ± 21.3 |
| 587 | 19.6 | 70.6 | 19.3 | 69.5 | 19.5 ± 0.2 | 70.1 ± 0.5 |

Antibody encoding plasmid DNA was transfected into Expi293-F™ cells (GIBCO) For protein purification, 8 μL of a 25% slurry solution of magnetic protein A beads (GenScript) were added to 30 μg of expressed mAb and incubated overnight with shaking at 37° C. The next day, beads were washed and protein eluted with 480 μL of 100 mM glycine pH 2.0. Elution fractions were neutralized to pH 7.0 and dried onto filter plates. The dried mAb was resuspended in buffer to a final concentration of approximately 1 mg/mL and sterile filtered. Purified mAbs were quantified by bio-layer interferometry using an Octet HTX instrument (forteBIO). Purity of mAbs was analyzed by denaturing capillary electrophoresis (CE) SDS page using a LabChip instrument (Perkin Elmer) according to the manufacturer's protocol. The data were analyzed using the LabChip GX Reviewer Software (Perkin Elmer). See Tables 2-2 and 2-3. No value available where empty.

TABLE 2-2

Purification yields (N = 2) after being buffer exchanged into phosphate buffered saline.

| Antibody ID | Concentration (μg/mL) replica 1 | Amount (μg) replica 1 | Concentration (μg/mL) replica 2 | Amount (μg) replica 2 | Average concentration (μg/mL) ± SD | Average amount (μg) ± SD |
|---|---|---|---|---|---|---|
| 258 | 1852 | 253 | 1819 | 236 | 1836 ± 17 | 245 ± 9 |
| 261 | 2412 | 330 | 3585 | 465 | 2999 ± 587 | 397 ± 68 |
| 262 | 1057 | 142 | 1593 | 204 | 1325 ± 268 | 173 ± 31 |
| 268 | 264 | 36 | 134 | 17 | 199 ± 65 | 27 ± 10 |
| 269 | 1516 | 204 | 1009 | 129 | 1263 ± 254 | 166 ± 37 |
| 272 | 314 | 42 | 318 | 41 | 316 ± 2 | 42 ± 1 |
| 274 | 1195 | 160 | 2029 | 260 | 1612 ± 417 | 210 ± 50 |
| 275 | 2589 | 354 | 4231 | 549 | 3410 ± 821 | 451 ± 98 |
| 277 | 422 | 58 | 1286 | 167 | 854 ± 432 | 112 ± 55 |
| 278 | 1479 | 202 | 1311 | 170 | 1395 ± 84 | 186 ± 16 |
| 279 | 1277 | 171 | 1381 | 177 | 1329 ± 52 | 174 ± 3 |
| 280 | 281 | 38 | 305 | 40 | 293 ± 12 | 39 ± 1 |
| 283 | 996 | 134 | 1271 | 163 | 1133 ± 138 | 148 ± 15 |
| 285 | 2210 | 302 | 2041 | 265 | 2125 ± 84 | 284 ± 19 |
| 286 | 445 | 61 | 99 | 13 | 272 ± 173 | 37 ± 24 |

TABLE 2-2-continued

Purification yields (N = 2) after being buffer exchanged into phosphate buffered saline.

| Antibody ID | Concentration (μg/mL) replica 1 | Amount (μg) replica 1 | Concentration (μg/mL) replica 2 | Amount (μg) replica 2 | Average concentration (μg/mL) ± SD | Average amount (μg) ± SD |
|---|---|---|---|---|---|---|
| 287 | 1127 | 154 | 583 | 76 | 855 ± 272 | 115 ± 39 |
| 291 | 4277 | 574 | 4559 | 585 | 4418 ± 141 | 580 ± 5 |
| 292 | 2589 | 354 | 3552 | 461 | 3070 ± 482 | 407 ± 54 |
| 296 | 1638 | 220 | 1124 | 144 | 1381 ± 257 | 182 ± 38 |
| 297 | 544 | 74 | 690 | 89 | 617 ± 73 | 82 ± 7 |
| 298 | 918 | 123 | 1451 | 186 | 1185 ± 266 | 155 ± 31 |
| 302 | 1066 | 146 | 843 | 109 | 954 ± 111 | 127 ± 18 |
| 304 | 1908 | 261 | 1933 | 251 | 1920 ± 13 | 256 ± 5 |
| 305 | 632 | 85 | 1254 | 161 | 943 ± 311 | 123 ± 38 |
| 307 | 614 | 84 | 730 | 95 | 672 ± 58 | 89 ± 6 |
| 308 | 2080 | 279 | 1880 | 241 | 1980 ± 100 | 260 ± 19 |
| 309 | 2325 | 318 | 2893 | 375 | 2609 ± 284 | 346 ± 29 |
| 310 | 2406 | 323 | 1763 | 226 | 2084 ± 321 | 274 ± 48 |
| 311 | 1809 | 243 | 1812 | 232 | 1810 ± 2 | 237 ± 5 |
| 312 | 442 | 59 | 726 | 93 | 584 ± 142 | 76 ± 17 |
| 313 | 2443 | 328 | 3228 | 414 | 2835 ± 393 | 371 ± 43 |
| 314 | 8 | 1 | 8 | 1 | 8 ± 0 | 1 ± 0 |
| 318 | 1059 | 142 | 816 | 105 | 938 ± 122 | 124 ± 19 |
| 321 | 172 | 23 | 153 | 20 | 162 ± 9 | 22 ± 2 |
| 322 | 2401 | 322 | 2841 | 364 | 2621 ± 220 | 343 ± 21 |
| 325 | 2164 | 291 | 2018 | 259 | 2091 ± 73 | 275 ± 16 |
| 330 | 1920 | 258 | 2261 | 290 | 2091 ± 170 | 274 ± 16 |
| 334 | 621 | 83 | 650 | 83 | 636 ± 14 | 83 ± 0 |
| 335 | 0 | 0 | 0 | 0 | 0 ± 0 | 0 ± 0 |
| 336 | 602 | 81 | 862 | 111 | 732 ± 130 | 96 ± 15 |
| 338 | 982 | 132 | 1423 | 182 | 1202 ± 221 | 157 ± 25 |
| 341 | 39 | 5 | 17 | 2 | 28 ± 11 | 4 ± 2 |
| 346 | 554 | 76 | 206 | 27 | 380 ± 174 | 51 ± 24 |
| 350 | 1370 | 184 | 1332 | 171 | 1351 ± 19 | 178 ± 7 |
| 352 | 824 | 111 | 1261 | 162 | 1043 ± 218 | 136 ± 26 |
| 353 | 1885 | 258 | 2166 | 281 | 2026 ± 140 | 269 ± 12 |
| 354 | 1052 | 144 | 889 | 115 | 971 ± 82 | 129 ± 14 |
| 355 | 118 | 16 | 125 | 16 | 122 ± 3 | 16 ± 0 |
| 356 | 944 | 129 | 1292 | 168 | 1118 ± 174 | 149 ± 20 |
| 357 | 3560 | 478 | 3451 | 443 | 3506 ± 55 | 461 ± 18 |
| 358 | 2356 | 322 | 2867 | 372 | 2611 ± 256 | 347 ± 25 |
| 359 | 2861 | 391 | 3390 | 440 | 3126 ± 264 | 416 ± 25 |
| 360 | 1637 | 224 | 2625 | 341 | 2131 ± 494 | 282 ± 59 |
| 361 | 1113 | 149 | 1057 | 136 | 1085 ± 28 | 143 ± 7 |
| 364 | 86 | 12 | 213 | 28 | 149 ± 64 | 20 ± 8 |
| 368 | 1273 | 171 | 1018 | 131 | 1145 ± 127 | 151 ± 20 |
| 369 | 985 | 135 | 1428 | 185 | 1207 ± 222 | 160 ± 25 |
| 370 | 923 | 124 | 942 | 121 | 932 ± 10 | 122 ± 1 |
| 371 | 1058 | 142 | 1780 | 228 | 1419 ± 361 | 185 ± 43 |
| 373 | 938 | 128 | 778 | 101 | 858 ± 80 | 115 ± 14 |
| 374 | 1926 | 263 | 2356 | 306 | 2141 ± 215 | 285 ± 21 |
| 377 | 1708 | 229 | 2337 | 300 | 2023 ± 314 | 265 ± 35 |
| 381 | 1755 | 240 | 2199 | 285 | 1977 ± 222 | 262 ± 23 |
| 382 | 759 | 104 | 862 | 112 | 811 ± 51 | 108 ± 4 |
| 383 | 885 | 121 | 914 | 119 | 900 ± 14 | 120 ± 1 |
| 384 | 433 | 59 | 506 | 66 | 469 ± 37 | 63 ± 3 |
| 386 | 0 | 0 | 0 | 0 | 0 ± 0 | 0 ± 0 |
| 387 | 862 | 116 | 1395 | 179 | 1128 ± 267 | 147 ± 32 |
| 388 | 1867 | 255 | 2929 | 380 | 2398 ± 531 | 318 ± 62 |
| 389 | 1149 | 154 | 1021 | 131 | 1085 ± 64 | 143 ± 12 |
| 390 | 2065 | 277 | 2067 | 265 | 2066 ± 1 | 271 ± 6 |
| 391 | 1020 | 137 | 1000 | 128 | 1010 ± 10 | 132 ± 4 |
| 393 | 2614 | 357 | 2548 | 331 | 2581 ± 33 | 344 ± 13 |
| 394 | 1632 | 219 | 1340 | 172 | 1486 ± 146 | 196 ± 24 |
| 397 | 1035 | 139 | 1477 | 189 | 1256 ± 221 | 164 ± 25 |
| 399 | 2668 | 358 | 2534 | 325 | 2601 ± 67 | 342 ± 17 |
| 400 | 4241 | 569 | 5563 | 713 | 4902 ± 661 | 641 ± 72 |
| 401 | 209 | 28 | 280 | 36 | 244 ± 36 | 32 ± 4 |
| 402 | 879 | 120 | 773 | 100 | 826 ± 53 | 110 ± 10 |
| 403 | 1939 | 265 | 2308 | 299 | 2124 ± 184 | 282 ± 17 |
| 404 | 363 | 49 | 448 | 57 | 406 ± 42 | 53 ± 4 |
| 408 | 896 | 123 | 809 | 105 | 853 ± 44 | 114 ± 9 |
| 410 | 1866 | 255 | 2162 | 281 | 2014 ± 148 | 268 ± 13 |
| 411 | 0 | 0 | 0 | 0 | 0 ± 0 | 0 ± 0 |
| 413 | 2729 | 366 | 2010 | 258 | 2370 ± 360 | 312 ± 54 |
| 414 | 394 | 54 | 475 | 62 | 434 ± 41 | 58 ± 4 |
| 415 | 2606 | 356 | 2926 | 380 | 2766 ± 160 | 368 ± 12 |
| 417 | 1464 | 200 | 1247 | 162 | 1356 ± 109 | 181 ± 19 |

TABLE 2-2-continued

Purification yields (N = 2) after being buffer exchanged into phosphate buffered saline.

| Antibody ID | Concentration (µg/mL) replica 1 | Amount (µg) replica 1 | Concentration (µg/mL) replica 2 | Amount (µg) replica 2 | Average concentration (µg/mL) ± SD | Average amount (µg) ± SD |
|---|---|---|---|---|---|---|
| 419 | 1625 | 218 | 1316 | 169 | 1471 ± 155 | 194 ± 25 |
| 420 | 17 | 2 | 19 | 2 | 18 ± 1 | 2 ± 0 |
| 426 | 0 | 0 | 0 | 0 | 0 ± 0 | 0 ± 0 |
| 428 | 1064 | 146 | 871 | 113 | 968 ± 97 | 129 ± 16 |
| 429 | 1306 | 178 | 1443 | 187 | 1374 ± 69 | 183 ± 4 |
| 430 | 205 | 28 | 240 | 31 | 222 ± 18 | 29 ± 2 |
| 432 | 256 | 35 | 222 | 29 | 239 ± 17 | 32 ± 3 |
| 433 | 4217 | 566 | 2740 | 351 | 3478 ± 738 | 459 ± 108 |
| 436 | 1117 | 153 | 962 | 125 | 1039 ± 77 | 139 ± 14 |
| 438 | 148 | 20 | 163 | 21 | 156 ± 7 | 21 ± 0 |
| 440 | 1715 | 230 | 1192 | 153 | 1453 ± 261 | 192 ± 39 |
| 441 | 1637 | 220 | 2282 | 293 | 1959 ± 323 | 256 ± 37 |
| 442 | 2331 | 319 | 2230 | 289 | 2280 ± 50 | 304 ± 15 |
| 444 | 763 | 102 | 974 | 125 | 868 ± 106 | 114 ± 11 |
| 445 | 1892 | 254 | 1630 | 209 | 1761 ± 131 | 231 ± 22 |
| 447 | 1599 | 219 | 1885 | 245 | 1742 ± 143 | 232 ± 13 |
| 448 | 1326 | 178 | 1139 | 146 | 1233 ± 94 | 162 ± 16 |
| 449 | 2391 | 321 | 3216 | 412 | 2804 ± 412 | 367 ± 46 |
| 450 | 80 | 11 | 66 | 9 | 73 ± 7 | 10 ± 1 |
| 451 | 2382 | 320 | 2657 | 341 | 2520 ± 137 | 330 ± 11 |
| 453 | 1683 | 230 | 1713 | 222 | 1698 ± 15 | 226 ± 4 |
| 455 | 2229 | 299 | 2560 | 328 | 2394 ± 166 | 314 ± 14 |
| 457 | 0 | 0 | 0 | 0 | 0 ± 0 | 0 ± 0 |
| 458 | 2698 | 362 | 2736 | 351 | 2717 ± 19 | 357 ± 6 |
| 459 | 1311 | 179 | 1587 | 206 | 1449 ± 138 | 193 ± 13 |
| 460 | 2155 | 289 | 1854 | 238 | 2005 ± 151 | 264 ± 26 |
| 461 | 1164 | 156 | 1515 | 194 | 1340 ± 175 | 175 ± 19 |
| 462 | 700 | 96 | 795 | 103 | 747 ± 48 | 99 ± 4 |
| 463 | 2173 | 297 | 1963 | 255 | 2068 ± 105 | 276 ± 21 |
| 464 | 1958 | 263 | 1513 | 194 | 1735 ± 222 | 228 ± 34 |
| 465 | 1849 | 248 | 2070 | 266 | 1959 ± 111 | 257 ± 9 |
| 466 | 0 | 0 | 0 | 0 | 0 ± 0 | 0 ± 0 |
| 467 | 450 | 60 | 483 | 62 | 466 ± 17 | 61 ± 1 |
| 468 | 2384 | 320 | 2152 | 276 | 2268 ± 116 | 298 ± 22 |
| 469 | 935 | 126 | 1025 | 131 | 980 ± 45 | 128 ± 3 |
| 472 | 1557 | 209 | 1846 | 237 | 1702 ± 144 | 223 ± 14 |
| 473 | 1327 | 181 | 1623 | 211 | 1475 ± 148 | 196 ± 15 |
| 478 | 2841 | 388 | 4098 | 532 | 3469 ± 629 | 460 ± 72 |
| 479 | 1488 | 203 | 1657 | 215 | 1573 ± 84 | 209 ± 6 |
| 481 | 958 | 131 | 1179 | 153 | 1068 ± 111 | 142 ± 11 |
| 482 | 436 | 59 | 456 | 59 | 446 ± 10 | 59 ± 0 |
| 483 | 1559 | 209 | 895 | 115 | 1227 ± 332 | 162 ± 47 |
| 484 | 411 | 56 | 389 | 51 | 400 ± 11 | 54 ± 3 |
| 486 | 2997 | 410 | 4063 | 527 | 3530 ± 533 | 468 ± 59 |
| 488 | 894 | 122 | 840 | 109 | 867 ± 27 | 116 ± 7 |
| 489 | 1241 | 170 | 1209 | 157 | 1225 ± 16 | 163 ± 6 |
| 490 | 0 | 0 | 0 | 0 | 0 ± 0 | 0 ± 0 |
| 491 | 2699 | 369 | 3986 | 517 | 3343 ± 643 | 443 ± 74 |
| 493 | 1645 | 221 | 2159 | 277 | 1902 ± 257 | 249 ± 28 |
| 494 | 252 | 34 | 305 | 39 | 279 ± 27 | 36 ± 3 |
| 495 | 1700 | 228 | 1736 | 223 | 1718 ± 18 | 226 ± 3 |
| 499 | 1584 | 213 | 1930 | 247 | 1757 ± 173 | 230 ± 17 |
| 500 | 947 | 129 | 1089 | 141 | 1018 ± 71 | 135 ± 6 |
| 501 | 2219 | 298 | 2206 | 283 | 2212 ± 6 | 290 ± 7 |
| 502 | 360 | 49 | 666 | 86 | 513 ± 153 | 68 ± 18 |
| 503 | 1280 | 172 | 502 | 64 | 891 ± 389 | 118 ± 54 |
| 506 | 2079 | 279 | 1848 | 237 | 1963 ± 115 | 258 ± 21 |
| 508 | 954 | 130 | 580 | 75 | 767 ± 187 | 103 ± 28 |
| 511 | 1290 | 173 | 901 | 116 | 1095 ± 194 | 145 ± 29 |
| 513 | 3893 | 523 | 4089 | 524 | 3991 ± 98 | 523 ± 1 |
| 515 | 860 | 116 | 1082 | 139 | 971 ± 111 | 127 ± 12 |
| 518 | 966 | 132 | 1687 | 219 | 1327 ± 360 | 176 ± 43 |
| 519 | 2527 | 345 | 3749 | 486 | 3138 ± 611 | 416 ± 70 |
| 520 | 1263 | 170 | 2202 | 282 | 1733 ± 469 | 226 ± 56 |
| 521 | 1186 | 159 | 898 | 115 | 1042 ± 144 | 137 ± 22 |
| 524 | 2218 | 298 | 2596 | 333 | 2407 ± 189 | 315 ± 18 |
| 525 | 2211 | 297 | 2073 | 266 | 2142 ± 69 | 281 ± 15 |
| 526 | 1410 | 193 | 988 | 128 | 1199 ± 211 | 160 ± 32 |
| 528 | 1357 | 185 | 1189 | 154 | 1273 ± 84 | 170 ± 16 |
| 529 | 17 | 2 | 13 | 2 | 15 ± 2 | 2 ± 0 |
| 530 | 1092 | 149 | 1111 | 144 | 1101 ± 10 | 147 ± 3 |
| 532 | 259 | 35 | 247 | 32 | 253 ± 6 | 34 ± 2 |
| 534 | 1515 | 207 | 1284 | 167 | 1399 ± 115 | 187 ± 20 |

TABLE 2-2-continued

Purification yields (N = 2) after being buffer exchanged into phosphate buffered saline.

| Antibody ID | Concentration (µg/mL) replica 1 | Amount (µg) replica 1 | Concentration (µg/mL) replica 2 | Amount (µg) replica 2 | Average concentration (µg/mL) ± SD | Average amount (µg) ± SD |
|---|---|---|---|---|---|---|
| 535 | 2033 | 273 | 1559 | 200 | 1796 ± 237 | 236 ± 36 |
| 539 | 1762 | 237 | 1465 | 188 | 1613 ± 148 | 212 ± 24 |
| 540 | 973 | 131 | 1214 | 156 | 1093 ± 121 | 143 ± 13 |
| 549 | 578 | 79 | 493 | 64 | 535 ± 42 | 71 ± 7 |
| 552 | 2264 | 304 | 1833 | 235 | 2048 ± 215 | 269 ± 34 |
| 553 | 37 | 5 | 22 | 3 | 29 ± 7 | 4 ± 1 |
| 554 | 1990 | 272 | 2118 | 275 | 2054 ± 64 | 273 ± 2 |
| 555 | 140 | 19 | 122 | 16 | 131 ± 9 | 18 ± 2 |
| 557 | 3462 | 473 | 4758 | 617 | 4110 ± 648 | 545 ± 72 |
| 558 | 5285 | 710 | 5164 | 662 | 5225 ± 61 | 686 ± 24 |
| 559 | 2984 | 401 | 3322 | 426 | 3153 ± 169 | 413 ± 13 |
| 561 | 2440 | 334 | 3954 | 513 | 3197 ± 757 | 423 ± 90 |
| 562 | 2714 | 364 | 2464 | 316 | 2589 ± 125 | 340 ± 24 |
| 565 | 804 | 108 | 595 | 76 | 699 ± 104 | 92 ± 16 |
| 567 | 636 | 85 | 1867 | 239 | 1252 ± 615 | 162 ± 77 |
| 568 | 953 | 128 | 968 | 124 | 961 ± 7 | 126 ± 2 |
| 570 | 1536 | 206 | 1337 | 171 | 1436 ± 99 | 189 ± 18 |
| 572 | 0 | 0 | 0 | 0 | 0 ± 0 | 0 ± 0 |
| 573 | 0 | 0 | 0 | 0 | 0 ± 0 | 0 ± 0 |
| 574 | 2233 | 300 | 3209 | 412 | 2721 ± 488 | 356 ± 56 |
| 575 | 897 | 120 | 1435 | 184 | 1166 ± 269 | 152 ± 32 |
| 577 | 1185 | 159 | 670 | 86 | 927 ± 257 | 123 ± 37 |
| 579 | 255 | 35 | 239 | 31 | 247 ± 8 | 33 ± 2 |
| 584 | 996 | 136 | 792 | 103 | 894 ± 102 | 120 ± 17 |
| 585 | 1503 | 202 | 2011 | 258 | 1757 ± 254 | 230 ± 28 |
| 587 | 168 | 23 | 138 | 18 | 153 ± 15 | 21 ± 3 |

TABLE 2-3

Purity (%) and apparent molecular weight (MW) (N = 1) of monoclonal antibodies using capillary electrophoresis (CE) SDS PAGE.

| Antibody ID | Purity (%) | Apparent MW (kDa) |
|---|---|---|
| 258 | 100 | 191 |
| 261 | 86 | 182 |
| 262 | | |
| 268 | | |
| 269 | 100 | 200 |
| 272 | | |
| 274 | | |
| 275 | 97 | 175 |
| 277 | | |
| 278 | 95 | 195 |
| 279 | 100 | 197 |
| 280 | | |
| 283 | 90 | 191 |
| 285 | 100 | 192 |
| 286 | | |
| 287 | 100 | 196 |
| 291 | 100 | 197 |
| 292 | 100 | 185 |
| 296 | | |
| 297 | | |
| 298 | 96 | 187 |
| 302 | 98 | 180 |
| 304 | 100 | 177 |
| 305 | 100 | 192 |
| 307 | | |
| 308 | 93 | 196 |
| 309 | 94 | 174 |
| 310 | 90 | 193 |
| 311 | 95 | 180 |
| 312 | | |
| 313 | 91 | 182 |
| 314 | | |
| 318 | 100 | 197 |
| 321 | | |
| 322 | 100 | 182 |
| 325 | 91 | 178 |
| 330 | 100 | 186 |
| 334 | | |
| 335 | | |
| 336 | | |
| 338 | 93 | 191 |
| 341 | | |
| 346 | | |
| 350 | 90 | 193 |
| 352 | 92 | 199 |
| 353 | 100 | 174 |
| 354 | 99 | 176 |
| 355 | | |
| 356 | 100 | 175 |
| 357 | 94 | 190 |
| 358 | 100 | 173 |
| 359 | 100 | 177 |
| 360 | 100 | 171 |
| 361 | 96 | 199 |
| 364 | | |
| 368 | 93 | 184 |
| 369 | 100 | 176 |
| 370 | 100 | 197 |
| 371 | 100 | 198 |
| 373 | 100 | 179 |
| 374 | 100 | 181 |
| 377 | | |
| 381 | 100 | 179 |
| 382 | 100 | 175 |
| 383 | 100 | 171 |
| 384 | | |
| 386 | | |
| 387 | 100 | 194 |
| 388 | 100 | 175 |
| 389 | 100 | 194 |
| 390 | 100 | 191 |
| 391 | 100 | 193 |

TABLE 2-3-continued

Purity (%) and apparent molecular weight (MW) (N = 1) of monoclonal antibodies using capillary electrophoresis (CE) SDS PAGE.

| Antibody ID | Purity (%) | Apparent MW (kDa) |
|---|---|---|
| 393 | 100 | 178 |
| 394 | 100 | 195 |
| 397 | 100 | 195 |
| 399 | 95 | 195 |
| 400 | | |
| 401 | | |
| 402 | 100 | 175 |
| 403 | 94 | 171 |
| 404 | | |
| 408 | 100 | 180 |
| 410 | 100 | 172 |
| 411 | | |
| 413 | 100 | 194 |
| 414 | | |
| 415 | 100 | 173 |
| 417 | 100 | 170 |
| 419 | 100 | 194 |
| 420 | | |
| 426 | | |
| 428 | 100 | 177 |
| 429 | 100 | 183 |
| 430 | | |
| 432 | | |
| 433 | 100 | 184 |
| 436 | 100 | 191 |
| 438 | | |
| 440 | 90 | 186 |
| 441 | 100 | 189 |
| 442 | 91 | 182 |
| 444 | | |
| 445 | 97 | 198 |
| 447 | 100 | 179 |
| 448 | 97 | 193 |
| 449 | 100 | 199 |
| 450 | | |
| 451 | 100 | 197 |
| 453 | 100 | 189 |
| 455 | 92 | 194 |
| 457 | | |
| 458 | 100 | 192 |
| 459 | | |
| 460 | 100 | 194 |
| 461 | 90 | 198 |
| 462 | 100 | 189 |
| 463 | 100 | 188 |
| 464 | 91 | 192 |
| 465 | 94 | 188 |
| 466 | | |
| 467 | | |
| 468 | 100 | 194 |
| 469 | 100 | 196 |
| 472 | 100 | 191 |
| 473 | 100 | 191 |
| 478 | 100 | 185 |
| 479 | 100 | 182 |
| 481 | 100 | 184 |
| 482 | | |
| 483 | | |
| 484 | | |
| 486 | 100 | 177 |
| 488 | 100 | 182 |
| 489 | 100 | 187 |
| 490 | | |
| 491 | 100 | 175 |
| 493 | 100 | 194 |
| 494 | | |
| 495 | 95 | 191 |
| 499 | 100 | 188 |
| 500 | 100 | 188 |
| 501 | 95 | 198 |
| 502 | | |
| 503 | | |
| 506 | 94 | 195 |
| 508 | 98 | 179 |
| 511 | | |
| 513 | 100 | 199 |
| 515 | 88 | 195 |
| 518 | 100 | 180 |
| 519 | 100 | 183 |
| 520 | 86 | 195 |
| 521 | | |
| 524 | 92 | 192 |
| 525 | 84 | 192 |
| 526 | 100 | 186 |
| 528 | 100 | 185 |
| 529 | | |
| 530 | 100 | 184 |
| 532 | | |
| 534 | 98 | 195 |
| 535 | 90 | 193 |
| 539 | 100 | 200 |
| 540 | 100 | 182 |
| 549 | | |
| 552 | 100 | 196 |
| 553 | | |
| 554 | 100 | 190 |
| 555 | | |
| 557 | 100 | 190 |
| 558 | 100 | 196 |
| 559 | 93 | 188 |
| 561 | 100 | 189 |
| 562 | 100 | 196 |
| 565 | | |
| 567 | 98 | 178 |
| 568 | 100 | 181 |
| 570 | 91 | 197 |
| 572 | | |
| 573 | | |
| 574 | 100 | 182 |
| 575 | 100 | 179 |
| 577 | | |
| 579 | | |
| 584 | 100 | 189 |
| 585 | 100 | 189 |
| 587 | | |

The melting temperature (Tm) of mAbs was assessed by differential scanning fluorimetry (DSF) using a Thermal Cycler instrument (Bio-Rad)). 6 μL of mAb solution at 350 μg/mL was mixed with 6 μL of a 19× concentrated SYPRO™ Orange solution (Thermo Fisher). Thermal unfolding as assessed by a change in fluorescence was measured at a starting temperature of 25° C. and increased to 95° C. in 0.5° C./min increments. Data was analyzed and melting curves integrated using the Bio-Rad CFX Maestro software. The Tm was defined as the local minimum taken from the derivative of the melting curve. See Table 2-4. No value available where empty.

TABLE 2-4

Melting point (Tm) (N = 1) of monoclonal antibodies in the differential scanning fluorimetry (DSF) assay.

| Antibody ID | Tm (° C.) |
|---|---|
| 258 | 67.5 |
| 261 | 67 |
| 262 | 67 |
| 268 | |
| 269 | 67 |
| 272 | |
| 274 | |
| 275 | 67 |
| 277 | |
| 278 | 67.5 |

TABLE 2-4-continued

Melting point (Tm) (N = 1) of monoclonal antibodies in the differential scanning fluorimetry (DSF) assay.

| Antibody ID | Tm (° C.) |
|---|---|
| 279 | 67 |
| 280 | |
| 283 | 66 |
| 285 | 67 |
| 286 | |
| 287 | 67 |
| 291 | 67 |
| 292 | 62.5 |
| 296 | 65.5 |
| 297 | |
| 298 | 66 |
| 302 | 67 |
| 304 | 65.5 |
| 305 | 67.5 |
| 307 | |
| 308 | 67.5 |
| 309 | 66.5 |
| 310 | 66.5 |
| 311 | 66.5 |
| 312 | |
| 313 | 67 |
| 314 | |
| 318 | 61.5 |
| 321 | |
| 322 | 66.5 |
| 325 | 66.5 |
| 330 | 66.5 |
| 334 | |
| 335 | |
| 336 | |
| 338 | 66.5 |
| 341 | |
| 346 | |
| 350 | 67 |
| 352 | 64.5 |
| 353 | 66.5 |
| 354 | 67 |
| 355 | |
| 356 | 67 |
| 357 | 67 |
| 358 | 67 |
| 359 | 66.5 |
| 360 | 66.5 |
| 361 | 67 |
| 364 | |
| 368 | 67 |
| 369 | 67 |
| 370 | 63 |
| 371 | 67 |
| 373 | 67 |
| 374 | 67 |
| 377 | 64 |
| 381 | 67 |
| 382 | 66 |
| 383 | 66 |
| 384 | |
| 386 | |
| 387 | 66.5 |
| 388 | 67 |
| 389 | 66 |
| 390 | 65.5 |
| 391 | 64 |
| 393 | 67 |
| 394 | 66.5 |
| 397 | 66 |
| 399 | 66.5 |
| 400 | |
| 401 | |
| 402 | 67.5 |
| 403 | 68 |
| 404 | |
| 408 | 67 |
| 410 | 67 |
| 411 | |
| 413 | 64.5 |
| 414 | |
| 415 | 67 |
| 417 | 67 |
| 419 | 66.5 |
| 420 | |
| 426 | |
| 428 | 67 |
| 429 | 67 |
| 430 | |
| 432 | |
| 433 | 66.5 |
| 436 | 67.5 |
| 438 | |
| 440 | 60 |
| 441 | 59.5 |
| 442 | 67 |
| 444 | |
| 445 | 67 |
| 447 | 67 |
| 448 | 63.5 |
| 449 | 67 |
| 450 | |
| 451 | 65.5 |
| 453 | 66 |
| 455 | 65.5 |
| 457 | |
| 458 | |
| 459 | 67 |
| 460 | 65 |
| 461 | 66.5 |
| 462 | 65.5 |
| 463 | 67 |
| 464 | 66 |
| 465 | 66.5 |
| 466 | |
| 467 | |
| 468 | 67 |
| 469 | 66 |
| 472 | 62 |
| 473 | 67.5 |
| 478 | 67 |
| 479 | 67 |
| 481 | 61 |
| 482 | |
| 483 | 66 |
| 484 | |
| 486 | 67 |
| 488 | 67 |
| 489 | 67 |
| 490 | |
| 491 | 67 |
| 493 | 66.5 |
| 494 | |
| 495 | 62.5 |
| 499 | 66 |
| 500 | 67 |
| 501 | 65.5 |
| 502 | |
| 503 | |
| 506 | 67 |
| 508 | 67 |
| 511 | |
| 513 | 67 |
| 515 | 66 |
| 518 | 67 |
| 519 | 67 |
| 520 | 65 |
| 521 | |
| 524 | 67 |
| 525 | 67 |
| 526 | 67 |
| 528 | 67 |
| 529 | |
| 530 | 67 |
| 532 | |

TABLE 2-4-continued

Melting point (Tm) (N = 1) of monoclonal antibodies in the differential scanning fluorimetry (DSF) assay.

| Antibody ID | Tm (° C.) |
|---|---|
| 534 | 67 |
| 535 | 65.5 |
| 539 | 67 |
| 540 | 66.5 |
| 549 | |
| 552 | 65.5 |
| 553 | |
| 554 | 67.5 |
| 555 | |
| 557 | 67.5 |
| 558 | 67 |
| 559 | 67 |
| 561 | 67 |
| 562 | 66.5 |
| 565 | |
| 567 | 67 |
| 568 | 67.5 |
| 570 | 66.5 |
| 572 | |
| 573 | |
| 574 | 67 |
| 575 | 67 |
| 577 | |
| 579 | |
| 584 | 67 |
| 585 | 63.5 |
| 587 | |

Percent aggregation and polydispersity of mAbs was assessed by dynamic light scattering (DLS) on a DYNAPRO® Plate Reader III instrument (Wyatt). DLS of individual samples (7 μL of mAb at varying concentrations (0.5-2 mg/mL)) was acquired at 20° C. with 5×5 s acquisitions per sample. Data was analyzed in the Dynamics software (Wyatt) using the regularization algorithm. Percent polydispersity and percent mass of soluble mAbs were calculated for the size range of 2 to 10 nm. See Table 2-5. No value available where empty.

TABLE 2-5

Amount of soluble antibody (%) and polydispersity of soluble antibody (%) determined by dynamic light scattering (DLS).

| Antibody ID | Amount soluble antibody (%) | Polydispersity of soluble antibody (%) |
|---|---|---|
| 258 | 99 | 24.7 |
| 261 | 96.3 | 12.6 |
| 262 | | |
| 268 | | |
| 269 | 99.3 | 36.2 |
| 272 | | |
| 274 | 96.2 | 36.3 |
| 275 | 100 | 10.4 |
| 277 | | |
| 278 | 57.5 | 11.1 |
| 279 | 97.7 | 41.9 |
| 280 | 100 | 18.3 |
| 283 | 97.4 | 18.7 |
| 285 | 86.1 | 18.3 |
| 286 | | |
| 287 | 96.4 | 14.7 |
| 291 | 99.5 | 14.6 |
| 292 | 99.7 | 24.4 |
| 296 | | |
| 297 | 99.9 | 10.9 |
| 298 | 97.7 | 24.2 |
| 302 | 99.9 | 6.6 |
| 304 | | |
| 305 | 96.2 | 23.1 |
| 307 | | |
| 308 | 91.2 | 13.4 |
| 309 | 100 | 24 |
| 310 | 93.2 | 12.4 |
| 311 | 93.8 | 35.2 |
| 312 | | |
| 313 | 94.9 | 30.1 |
| 314 | | |
| 318 | | |
| 321 | | |
| 322 | | |
| 325 | 98.2 | 37.6 |
| 330 | 93.3 | 24 |
| 334 | | |
| 335 | | |
| 336 | | |
| 338 | 99 | 17.6 |
| 341 | | |
| 346 | | |
| 350 | 99.9 | 23.3 |
| 352 | 95.6 | 23.3 |
| 353 | 100 | 15 |
| 354 | 99.9 | 8.7 |
| 355 | | |
| 356 | 100 | 18.3 |
| 357 | 96.6 | 11.1 |
| 358 | 98.8 | 28.1 |
| 359 | 100 | 13.9 |
| 360 | 100 | 17.6 |
| 361 | | |
| 364 | | |
| 368 | | |
| 369 | 100 | 16.3 |
| 370 | | |
| 371 | 96.1 | 38.6 |
| 373 | 99.8 | 16.2 |
| 374 | 98.1 | 23.1 |
| 377 | 97.2 | 39.7 |
| 381 | 99.3 | 18.2 |
| 382 | 100 | 12.5 |
| 383 | | |
| 384 | | |
| 386 | | |
| 387 | 99.2 | 15 |
| 388 | 99.8 | 15.6 |
| 389 | | |
| 390 | 99.9 | 17.1 |
| 391 | | |
| 393 | 100 | 16.6 |
| 394 | 99.5 | 23.6 |
| 397 | 100 | 39.2 |
| 399 | 99.7 | 30 |
| 400 | 85.2 | 33.1 |
| 401 | | |
| 402 | 99.5 | 5.8 |
| 403 | 99.2 | 23.1 |
| 404 | | |
| 408 | 100 | 18.1 |
| 410 | 99.9 | 28.4 |
| 411 | | |
| 413 | 98.5 | 27.3 |
| 414 | | |
| 415 | 100 | 30.9 |
| 417 | 97.5 | 22.4 |
| 419 | 100 | 20.9 |
| 420 | | |
| 426 | | |
| 428 | 98.7 | 27.7 |
| 429 | 100 | 15.6 |
| 430 | | |
| 432 | | |
| 433 | 99.7 | 32.7 |

TABLE 2-5-continued

Amount of soluble antibody (%) and polydispersity of soluble antibody (%) determined by dynamic light scattering (DLS).

| Antibody ID | Amount soluble antibody (%) | Polydispersity of soluble antibody (%) |
|---|---|---|
| 436 | 99.5 | 25.7 |
| 438 | | |
| 440 | | |
| 441 | 100 | 23.5 |
| 442 | 99.8 | 9.6 |
| 444 | | |
| 445 | 98.3 | 36 |
| 447 | 99.7 | 10.4 |
| 448 | | |
| 449 | 97.9 | 15 |
| 450 | | |
| 451 | 92.5 | 39.8 |
| 453 | 100 | 24.4 |
| 455 | 87.2 | 16.8 |
| 457 | | |
| 458 | 99.9 | 22.8 |
| 459 | 100 | 28.6 |
| 460 | 97.9 | 25.3 |
| 461 | 98.5 | 20.6 |
| 462 | 100 | 18.7 |
| 463 | 100 | 7 |
| 464 | 99.8 | 18.8 |
| 465 | 98.3 | 35 |
| 466 | | |
| 467 | | |
| 468 | 100 | 48.3 |
| 469 | | |
| 472 | 99.9 | 32.7 |
| 473 | 99.9 | 5.3 |
| 478 | 100 | 20.5 |
| 479 | | |
| 481 | 76.3 | 19.1 |
| 482 | | |
| 483 | | |
| 484 | | |
| 486 | 100 | 6.6 |
| 488 | 68.5 | 25.5 |
| 489 | | |
| 490 | | |
| 491 | 99.1 | 30.3 |
| 493 | 99.8 | 11.6 |
| 494 | | |
| 495 | 99.7 | 23.7 |
| 499 | 99.2 | 24.2 |
| 500 | 100 | 10.6 |
| 501 | 99.1 | 29.2 |
| 502 | | |
| 503 | | |
| 506 | 97.8 | 21.4 |
| 508 | 59.8 | 11.1 |
| 511 | | |
| 513 | 97.7 | 21.7 |
| 515 | | |
| 518 | 100 | 16.7 |
| 519 | 99.4 | 11.4 |
| 520 | 99.9 | 17.7 |
| 521 | | |
| 524 | 95.8 | 31 |
| 525 | 100 | 10.8 |
| 526 | 96.7 | 39.8 |
| 528 | 94 | 36.1 |
| 529 | | |
| 530 | 100 | 22.1 |
| 532 | | |
| 534 | 96 | 45.2 |
| 535 | 100 | 19.6 |
| 539 | 98.6 | 39.7 |
| 540 | 98.1 | 30.9 |
| 549 | | |
| 552 | 100 | 28.5 |
| 553 | | |
| 554 | 100 | 18.8 |
| 555 | | |
| 557 | 100 | 10.9 |
| 558 | 97.8 | 16.2 |
| 559 | 95 | 21.4 |
| 561 | 100 | 11.2 |
| 562 | 99 | 18.7 |
| 565 | | |
| 567 | 92.1 | 32.7 |
| 568 | 98.2 | 39.4 |
| 570 | 99.6 | 34.3 |
| 572 | | |
| 573 | | |
| 574 | 99.7 | 17.5 |
| 575 | 96.5 | 24.2 |
| 577 | | |
| 579 | | |
| 584 | | |
| 585 | 99.9 | 18.6 |
| 587 | | |

Example 3

Antibody Characterization Using High-Throughput Surface Plasmon Resonance

High-throughput surface plasmon resonance capture kinetic experiments were performed on an CARTERRA® LSA™ instrument equipped with an HC-30M chip type (Carterra, USA). The instrument uses two microfluidic modules, a single-flow channel (SFC) and a 96 multi-flow channel (MFC) printhead, to deliver samples to the chip surface via back-and-forth cycling of a fixed sample volume. An array comprised of as many as 384 ligands may be generated by docking the MFC onto each of the four nested print block locations in a serial manner.

Purified monoclonal antibodies obtained from HEK cells were immobilized on a chip by direct coupling. The chip surface was activated (e.g., flowing a freshly prepared 1:1:1 activation mix of 100 mM MES pH 5.5, 100 mM S-NHS, 400 mM EDC for 7 min) and mAbs diluted to either 10 µg/mL or 1 µg/mL (e.g., in 10 mM NaOAc pH 4.25+0.01% Tween 20) were injected and printed onto the chip surface using the MFC printhead for 10 min. The chip surface was quenched (e.g., flowing 1 M ethanolamine (pH 8.5) for 7 min to block excess reactive esters), followed by washing (e.g., twice with HBSTE (10 mM HEPES pH 7.4, 150 mM NaCl, 3 mM EDTA, 0.01% (v/v) Tween-20)+0.05% BSA for 15 s each time). Relevant benchmarks and negative control mAbs were also printed on the chip surface.

Solutions of the antigen of interest (e.g., SARS-CoV-2 Spike protein) at various concentrations (e.g., 300 nM, 100 nM, 33.3 nM, 11.1 nM, 3.7 nM, 1.2 nM, 0.4 nM, and 0.1 nM in HBSTE+0.05% BSA) were sequentially injected onto the chip surface. For each concentration, the antigen of interest was injected for 5 min (association phase), followed by running buffer injection for 15 min (dissociation phase). Two regeneration cycles were performed between each dilution series. In some instances, regeneration cycles were carried out for 1 minute in PIERCE™ IgG elution buffer (Thermo Fisher Scientific)+1M NaCl. In other instances, regeneration cycles were carried out for 15 seconds in 10 mM glycine (pH 2.0).

The data were analyzed using the CARTERRA® Kinetics analysis software and fit globally to a 1:1 Langmuir binding model to determine apparent association (ka) and dissociation (kd) kinetic rate constants and binding affinity constants (KD). See Table 3-1.

TABLE 3-1

Binding Kinetics (SARS-CoV-2 WT)

| Antibody ID | SARS-CoV-2 WT | | | SARS-CoV-2 D614G | | |
|---|---|---|---|---|---|---|
| | ka (M-1 s-1) | kd (s-1) | $K_D$ (M) | ka (M-1 s-1) | kd (s-1) | $K_D$ (M) |
| 258 | 8.40E+04 | 8.36E−05 | 9.96E−10 | | | |
| 261 | 1.29E+05 | 6.95E−04 | 5.37E−09 | | | |
| 269 | 6.09E+04 | 4.44E−04 | 7.29E−09 | | | |
| 274 | 3.01E+04 | 8.54E−04 | 2.84E−08 | | | |
| 275 | 1.01E+05 | 4.80E−05 | 4.73E−10 | | | |
| 277 | 3.05E+05 | 6.24E−05 | 2.04E−10 | | | |
| 278 | 2.01E+05 | 8.62E−04 | 4.28E−09 | | | |
| 279 | 3.73E+04 | 1.95E−03 | 5.23E−08 | | | |
| 283 | 1.28E+05 | 2.69E−05 | 2.11E−10 | | | |
| 285 | 1.57E+05 | 2.74E−04 | 1.75E−09 | | | |
| 291 | 4.64E+05 | 5.43E−05 | 1.17E−10 | | | |
| 297 | 7.98E+04 | 1.27E−04 | 1.60E−09 | | | |
| 298 | 5.97E+05 | 1.34E−05 | 2.25E−11 | | | |
| 302 | 1.05E+05 | 7.63E−05 | 7.26E−10 | | | |
| 304 | 8.73E+04 | 2.74E−04 | 3.14E−09 | | | |
| 305 | 7.26E+04 | 1.00E−03 | 1.38E−08 | | | |
| 307 | 1.01E+05 | 1.71E−03 | 1.70E−08 | | | |
| 308 | 1.39E+05 | 6.89E−05 | 4.95E−10 | | | |
| 309 | 5.96E+05 | 2.73E−05 | 4.58E−11 | | | |
| 310 | 1.21E+05 | 6.43E−05 | 5.32E−10 | | | |
| 311 | 2.13E+04 | 4.07E−04 | 1.91E−08 | | | |
| 313 | 5.02E+05 | 4.89E−05 | 9.75E−11 | | | |
| 318 | 1.52E+05 | 1.70E−03 | 1.11E−08 | | | |
| 322 | 1.90E+04 | 4.01E−04 | 2.11E−08 | | | |
| 325 | 2.09E+04 | 1.54E−04 | 7.36E−09 | | | |
| 330 | 7.65E+04 | 7.30E−04 | 9.54E−09 | | | |
| 336 | 1.90E+05 | 2.10E−04 | 1.11E−09 | | | |
| 338 | 5.02E+04 | 4.43E−05 | 8.82E−10 | | | |
| 350 | 2.45E+05 | 1.08E−04 | 4.42E−10 | | | |
| 352 | 3.69E+04 | 5.00E−04 | 1.35E−08 | | | |
| 353 | 6.80E+05 | 4.09E−05 | 6.01E−11 | | | |
| 354 | 4.11E+04 | 1.79E−03 | 4.36E−08 | | | |
| 356 | 2.65E+04 | 9.66E−05 | 3.65E−09 | | | |
| 357 | 7.80E+04 | 6.53E−05 | 8.37E−10 | | | |
| 358 | 2.89E+05 | 4.87E−04 | 1.69E−09 | | | |
| 359 | 1.51E+05 | 6.67E−05 | 4.41E−10 | | | |
| 360 | 1.04E+05 | 1.45E−04 | 1.40E−09 | | | |
| 361 | 3.80E+04 | 2.92E−05 | 7.69E−10 | | | |
| 368 | 3.81E+04 | 4.86E−04 | 1.27E−08 | | | |
| 369 | 3.16E+05 | 6.36E−05 | 2.01E−10 | | | |
| 370 | 1.78E+05 | 9.86E−04 | 5.55E−09 | | | |
| 371 | 1.72E+05 | 6.29E−05 | 3.66E−10 | | | |
| 373 | 5.12E+04 | 6.85E−04 | 1.34E−08 | | | |
| 374 | 4.96E+04 | 7.86E−05 | 1.58E−09 | | | |
| 381 | 3.11E+04 | 2.07E−04 | 6.66E−09 | | | |
| 382 | 1.20E+05 | 1.34E−03 | 1.12E−08 | | | |
| 383 | 9.18E+04 | 7.09E−05 | 7.72E−10 | | | |
| 387 | 2.16E+04 | 8.08E−04 | 3.74E−08 | | | |
| 388 | 6.10E+05 | 1.39E−05 | 2.28E−11 | | | |
| 389 | 4.50E+05 | 1.00E−05 | 2.22E−11 | | | |
| 390 | 1.29E+05 | 1.97E−05 | 1.53E−10 | | | |
| 391 | 2.70E+04 | 1.00E−05 | 3.70E−10 | | | |
| 393 | 9.41E+04 | 2.95E−05 | 3.13E−10 | | | |
| 394 | 2.66E+04 | 3.52E−05 | 1.32E−09 | | | |
| 397 | 5.91E+05 | 1.00E−05 | 1.69E−11 | | | |
| 399 | 3.17E+04 | 1.00E−05 | 3.15E−10 | | | |
| 400 | 4.88E+05 | 6.24E−04 | 1.28E−09 | | | |
| 402 | 3.04E+04 | 6.48E−05 | 2.14E−09 | | | |
| 403 | 3.40E+04 | 5.97E−05 | 1.76E−09 | | | |
| 408 | 3.86E+04 | 1.00E−05 | 2.59E−10 | | | |
| 410 | 1.61E+05 | 3.29E−04 | 2.05E−09 | | | |
| 413 | 2.96E+05 | 1.00E−05 | 3.38E−11 | | | |
| 415 | 8.02E+05 | 1.00E−05 | 1.25E−11 | | | |
| 417 | 4.21E+05 | 1.34E−04 | 3.18E−10 | | | |
| 419 | 6.55E+04 | 1.00E−05 | 1.53E−10 | | | |
| 428 | 2.38E+04 | 2.85E−04 | 1.20E−08 | | | |
| 429 | 2.09E+05 | 3.13E−05 | 1.50E−10 | | | |

TABLE 3-1-continued

| | Binding Kinetics (SARS-CoV-2 WT) | | | | | |
|---|---|---|---|---|---|---|
| Antibody | SARS-CoV-2 WT | | | SARS-CoV-2 D614G | | |
| ID | ka (M-1 s-1) | kd (s-1) | $K_D$ (M) | ka (M-1 s-1) | kd (s-1) | $K_D$ (M) |
| 433 | 1.25E+05 | 3.49E−04 | 2.80E−09 | | | |
| 436 | 1.82E+04 | 3.52E−04 | 1.94E−08 | | | |
| 440 | 3.67E+04 | 2.91E−04 | 7.93E−09 | | | |
| 441 | 9.19E+04 | 3.18E−04 | 3.46E−09 | | | |
| 442 | 4.58E+05 | 1.35E−04 | 2.95E−10 | | | |
| 444 | 2.64E+04 | 7.17E−04 | 2.72E−08 | | | |
| 445 | 1.49E+04 | 2.57E−05 | 1.73E−09 | | | |
| 447 | 3.58E+05 | 6.76E−05 | 1.89E−10 | | | |
| 448 | 1.85E+04 | 6.92E−04 | 3.75E−08 | | | |
| 449 | 5.74E+04 | 5.26E−04 | 9.17E−09 | | | |
| 451 | 1.40E+05 | 6.02E−05 | 4.29E−10 | | | |
| 453 | 9.56E+04 | 1.54E−04 | 1.61E−09 | | | |
| 455 | 1.07E+05 | 9.23E−05 | 8.66E−10 | | | |
| 458 | 2.66E+05 | 8.87E−05 | 3.34E−10 | | | |
| 459 | 9.57E+05 | 1.00E−05 | 1.05E−11 | | | |
| 461 | 9.63E+04 | 3.77E−04 | 3.92E−09 | | | |
| 462 | 1.25E+05 | 1.17E−03 | 9.31E−09 | | | |
| 463 | 2.29E+05 | 3.20E−05 | 1.40E−10 | | | |
| 464 | 1.12E+05 | 5.12E−04 | 4.58E−09 | | | |
| 465 | 8.70E+03 | 6.06E−05 | 6.97E−09 | | | |
| 468 | 7.92E+04 | 3.67E−05 | 4.63E−10 | | | |
| 469 | 6.30E+05 | 8.39E−05 | 1.33E−10 | | | |
| 472 | 2.13E+04 | 1.00E−05 | 4.69E−10 | | | |
| 473 | 1.15E+05 | 4.62E−04 | 4.01E−09 | | | |
| 478 | 1.09E+05 | 3.96E−04 | 3.62E−09 | | | |
| 479 | 2.36E+05 | 6.36E−05 | 2.69E−10 | | | |
| 481 | 1.09E+05 | 2.96E−05 | 2.73E−10 | | | |
| 483 | 1.61E+05 | 2.45E−05 | 1.52E−10 | | | |
| 486 | 2.35E+05 | 7.58E−05 | 3.22E−10 | | | |
| 488 | 5.36E+04 | 1.00E−05 | 1.87E−10 | | | |
| 489 | 1.53E+05 | 4.85E−05 | 3.17E−10 | | | |
| 491 | 3.69E+05 | 6.20E−05 | 1.68E−10 | | | |
| 493 | 7.50E+04 | 1.00E−05 | 1.33E−10 | | | |
| 495 | 2.16E+05 | 1.55E−05 | 7.18E−11 | | | |
| 499 | 6.33E+04 | 1.88E−05 | 2.97E−10 | | | |
| 500 | 2.66E+05 | 1.14E−04 | 4.30E−10 | | | |
| 501 | 2.98E+04 | 2.61E−04 | 8.78E−09 | | | |
| 502 | 1.08E+05 | 2.69E−04 | 2.49E−09 | | | |
| 506 | 4.01E+05 | 2.10E−04 | 5.23E−10 | | | |
| 511 | 2.42E+05 | 2.15E−04 | 8.87E−10 | | | |
| 513 | 2.63E+05 | 2.62E−05 | 9.96E−11 | | | |
| 515 | 3.02E+04 | 1.34E−03 | 4.42E−08 | | | |
| 518 | 4.01E+05 | 2.75E−05 | 6.85E−11 | | | |
| 519 | 1.41E+05 | 2.38E−04 | 1.69E−09 | | | |
| 520 | 4.36E+04 | 1.00E−05 | 2.29E−10 | | | |
| 521 | 3.02E+04 | 2.99E−04 | 9.90E−09 | | | |
| 524 | 7.86E+04 | 2.72E−03 | 3.46E−08 | | | |
| 525 | 3.67E+05 | 3.94E−05 | 1.07E−10 | | | |
| 526 | 2.89E+04 | 4.20E−04 | 1.45E−08 | | | |
| 528 | 5.60E+05 | 2.85E−04 | 5.09E−10 | | | |
| 530 | 9.54E+04 | 2.09E−04 | 2.19E−09 | | | |
| 534 | 2.48E+04 | 1.00E−05 | 4.04E−10 | | | |
| 535 | 1.05E+05 | 4.15E−05 | 3.95E−10 | | | |
| 539 | 9.26E+04 | 5.13E−04 | 5.54E−09 | | | |
| 540 | 9.25E+04 | 1.00E−05 | 1.08E−10 | | | |
| 552 | 2.58E+05 | 1.01E−05 | 3.93E−11 | | | |
| 554 | 2.71E+05 | 3.50E−05 | 1.29E−10 | | | |
| 555 | 6.27E+05 | 1.46E−05 | 2.59E−11 | 5.60E+05 | 1.00E−05 | 1.79E−11 |
| 557 | 2.33E+05 | 3.35E−05 | 1.44E−10 | | | |
| 558 | 3.78E+05 | 8.94E−05 | 2.37E−10 | | | |
| 559 | 1.96E+04 | 6.31E−04 | 3.22E−08 | | | |
| 561 | 2.90E+05 | 4.25E−05 | 1.46E−10 | | | |
| 562 | 5.48E+05 | 1.16E−05 | 2.11E−11 | | | |
| 567 | 1.83E+05 | 4.62E−04 | 2.52E−09 | | | |
| 570 | 2.20E+05 | 1.00E−05 | 4.54E−11 | | | |
| 574 | 1.32E+05 | 3.00E−04 | 2.28E−09 | | | |
| 575 | 1.33E+05 | 7.52E−04 | 5.65E−09 | | | |
| 584 | 6.55E+04 | 8.67E−04 | 1.32E−08 | | | |
| 585 | 1.85E+05 | 4.59E−05 | 2.48E−10 | | | |
| 851 | 6.96E+03 | 1.00E−05 | 1.44E−09 | | | |
| 894 | 1.15E+05 | 1.40E−05 | 1.21E−10 | | | |
| 923 | 6.53E+05 | 1.00E−05 | 1.61E−11 | 4.81E+05 | 1.00E−05 | 2.14E−11 |
| 970 | 7.06E+05 | 3.40E−04 | 4.82E−10 | | | |
| 1015 | 5.00E+05 | 2.19E−05 | 4.39E−11 | | | |

TABLE 3-1-continued

| | Binding Kinetics (SARS-CoV-2 WT) | | | | | |
|---|---|---|---|---|---|---|
| Antibody | SARS-CoV-2 WT | | | SARS-CoV-2 D614G | | |
| ID | ka (M-1 s-1) | kd (s-1) | $K_D$ (M) | ka (M-1 s-1) | kd (s-1) | $K_D$ (M) |
| 1037 | 4.43E+05 | 1.36E−05 | 3.19E−11 | 4.15E+05 | 1.00E−05 | 2.41E−11 |
| 1075 | 2.27E+05 | 3.04E−05 | 7.17E−10 | 2.97E+05 | 1.00E−05 | 3.65E−11 |
| 1139 | 1.22E+06 | 5.31E−05 | 4.33E−11 | | | |
| 1149 | 6.64E+05 | 1.00E−05 | 1.51E−11 | | | |
| 1404 | 4.60E+05 | 1.00E−05 | 2.18E−11 | | | |
| 1444 | 4.53E+05 | 1.00E−05 | 2.21E−11 | | | |
| 1495 | 1.03E+05 | 1.01E−05 | 9.72E−11 | | | |
| 1538 | 1.33E+05 | 1.00E−05 | 7.54E−11 | | | |
| 1585 | 5.86E+05 | 1.00E−05 | 1.71E−11 | | | |

Epitope binning experiments for mAbs coupled to chip were performed using the CARTERRA® LSA instrument. Samples were prepared by mixing each mAb in a 10 to 20-fold molar excess with the antigen of interest (e.g., 1:1 freshly prepared mix of 400 nM mAb and 40 nM Ag, both diluted in HBSTE+0.05% BSA running buffer. Using the SFC, each Ag-mAb premix was injected sequentially over the chip surface for 4 to 5 min (association phase to ligand previously printed onto chip), followed by a running buffer injection for 2 to 15 min (dissociation phase). Two regeneration cycles of 15-30 seconds were performed between each premix sample by injecting 10 mM glycine (pH 2.0) on the chip surface. An Ag-only injection (20 nM concentration in running buffer) was periodically performed as a reference (e.g., every eight cycles).

The data were analyzed using the CARTERRA® Epitope analysis software for heat map generation. Briefly, for each ligand, the analyte binding signals were normalized to the SARS-CoV-2-Spike protein-only binding signal, such that the SARS-CoV-2 Spike protein-only signal average is equivalent to one RU (relative unit). A threshold window ranging from 0.5-0.7 or 0.9-1.1 RU was used to classify analytes into 3 categories, i.e., blockers (analytes with a binding signal under the lower limit threshold), sandwichers (analytes with a binding signal over the higher limit threshold) and ambiguous (analytes with a signal falling between the lower and higher limit thresholds). The software then automatically clustered like-behaved mAbs into a heat map. See FIGS. 1A-1D.

Antibody blocking competition experiments were performed to test binding of antibodies to specific domains of SARS-CoV-2 Spike protein. Benchmark antibodies with known binding domains were used in competition experiments with identical set up described above. Binding to a specific Spike protein domain was determined by analyzing data for antibodies that competed with established benchmarks. Competition with a known antibody benchmark indicated binding to the same domain (see Tables 3-2 through 3-4). C indicates competition, C* indicates symmetric competition (competition observed regardless of which of the two antibodies was bound to the chip and which was soluble), NC indicates no competition, and blanks indicate no available data. mAbs S652-19, S652-22, S652-102, S652-118, S652-109, S652-115, S562-103, S562-112, and S562-116 are anti-SARS1 antibodies that are cross-reactive to SARS-CoV-2 obtained from the Dale and Betty Bumpers Vaccine Research Center (VRC) at the National Institutes of Health (NIH). Anti-SARS-CoV-2 antibodies 294, 419, 422, 488, 555, 923, 1037, 1075, 1081, 1130, and 1193 are described herein. 488Combo is an affinity matured anti-SARS-CoV-2 mAb from Eli Lilly. 4A8 is an anti-SARS-CoV-2 antibody described, e.g., in Chi et al., "A neutralizing human antibody binds to the N-terminal domain of the Spike protein of SARS-CoV-2." Science. 7 Aug. 2020: 650-655. CR3022 is an anti-SARS-CoV-2 antibody described, e.g., in Yuan et al., "A highly conserved cryptic epitope in the receptor binding domains of SARS-CoV-2 and SARS-CoV." Science. 8 May 2020: 630-633. CA1 & CB6 are anti-SARS-CoV-2 mAbs discovered by Junshi Biosciences and have been described previously. REGN10933 & REGN10987 are anti-SARS-CoV-2 mAbs discovered by Regeneron and described, e.g., in Hansen et al., "Studies in humanized mice and convalescent humans yield a SARS-CoV-2 antibody cocktail." Science. 21 Aug. 2020: 1010-1014. VIRS309 is an anti-SARS-CoV-2 antibody discovered by Vir Biotechnology and described, e.g., in Pint et al., "Cross-neutralization of SARS-CoV-2 by a human monoclonal SARS-CoV antibody." Nature. 583:290-295 (2020). S652-123 is a SARS1-specific antibody obtained from the VRC, 8203-C1 is an anti-foldon antibody, and PA1-983c is an anti-His tag antibody.

TABLE 3-2

Epitope Binning

| | Positive controls | | | | | | | | Negative controls | | |
|---|---|---|---|---|---|---|---|---|---|---|---|
| | S1 NTD | | | | | | | | | | |
| Antibody ID | S652-19 | S652-22 | S652-102 | S652-118 | 419 | 1075 | 1130 | 4A8 | S652-123 | 8203-C1 | PA1-983 |
| 258 | NC | NC | NC | NC | | | | | NC | NC | NC |
| 261 | C | C | C | C | | | | | NC | NC | NC |
| 269 | | | NC | | | | | | | | NC |
| 275 | NC | NC | NC | NC | | | | | NC | NC | NC |
| 277 | NC | NC | NC | NC | | | | | NC | NC | NC |
| 283 | NC | NC | NC | NC | | | | | NC | NC | NC |
| 285 | C | NC | NC | C | | | | | NC | NC | NC |

TABLE 3-2-continued

| | Epitope Binning | | | | | | | | | | |
|---|---|---|---|---|---|---|---|---|---|---|---|
| | Positive controls S1 NTD | | | | | | | | Negative controls | | |
| Antibody ID | S652-19 | S652-22 | S652-102 | S652-118 | 419 | 1075 | 1130 | 4A8 | S652-123 | 8203-C1 | PA1-983 |
| 291 | NC | NC | NC | NC | | | | | NC | NC | NC |
| 297 | NC | NC | NC | NC | | | | | NC | NC | NC |
| 298 | NC | NC | NC | NC | | | | | NC | NC | NC |
| 302 | NC | NC | NC | NC | | | | | NC | NC | NC |
| 308 | NC | NC | NC | NC | | | | | NC | NC | NC |
| 309 | NC | NC | NC | NC | | | | | NC | NC | NC |
| 310 | NC | NC | NC | NC | | | | | NC | NC | NC |
| 311 | NC | NC | NC | NC | | | | | NC | NC | NC |
| 313 | NC | NC | NC | NC | | | | | NC | NC | NC |
| 318 | | | NC | | | | | | | | NC |
| 325 | | | C | | | | | | | | NC |
| 336 | NC | NC | NC | NC | | | | | NC | NC | NC |
| 338 | NC | NC | NC | NC | | | | | NC | NC | NC |
| 350 | NC | NC | NC | NC | | | | | NC | NC | NC |
| 353 | NC | NC | NC | NC | | | | | NC | NC | NC |
| 356 | NC | NC | NC | NC | | | | | NC | NC | NC |
| 357 | NC | NC | NC | NC | | | | | NC | NC | NC |
| 358 | NC | NC | NC | NC | | | | | NC | NC | NC |
| 359 | NC | NC | NC | NC | | | | | NC | NC | NC |
| 360 | NC | NC | NC | NC | | | | | NC | NC | NC |
| 361 | NC | NC | NC | NC | | | | | NC | NC | NC |
| 369 | NC | NC | NC | NC | | | | | NC | NC | NC |
| 370 | | | NC | | | | | | | | NC |
| 381 | NC | NC | NC | NC | | | | | NC | NC | NC |
| 388 | NC | NC | NC | NC | | | | | NC | NC | NC |
| 389 | NC | NC | NC | NC | | | | | NC | NC | NC |
| 390 | NC | NC | NC | NC | | | | | NC | NC | NC |
| 391 | NC | NC | NC | NC | | | | | NC | NC | NC |
| 393 | NC | NC | NC | NC | | | | | NC | NC | NC |
| 394 | NC | NC | NC | NC | | | | | NC | NC | NC |
| 397 | NC | NC | NC | NC | | | | | NC | NC | NC |
| 400 | NC | NC | NC | NC | | | | | NC | NC | NC |
| 402 | NC | NC | NC | NC | | | | | NC | NC | NC |
| 408 | | | NC | | | | | | | | NC |
| 413 | NC | NC | NC | NC | | | | | NC | NC | NC |
| 415 | NC | NC | NC | NC | | | | | NC | NC | NC |
| 417 | C | C | C* | C | | | | | NC | NC | NC |
| 419 | | | NC | | | | | | | | NC |
| 428 | NC | NC | NC | NC | | | | | NC | NC | NC |
| 429 | NC | NC | NC | NC | | | | | NC | NC | NC |
| 441 | NC | NC | NC | NC | | | | | NC | NC | NC |
| 442 | | | NC | | | | | | | | NC |
| 447 | NC | NC | NC | NC | | | | | NC | NC | NC |
| 449 | C | NC | NC | C | | | | | NC | NC | NC |
| 453 | NC | NC | NC | NC | | | | | NC | NC | NC |
| 455 | NC | NC | NC | NC | | | | | NC | NC | NC |
| 458 | NC | NC | NC | NC | | | | | NC | NC | NC |
| 459 | | | NC | | | | | | | | NC |
| 460 | | | C | | | | | | | | NC |
| 461 | NC | NC | NC | NC | | | | | NC | NC | NC |
| 462 | | | NC | | | | | | | | NC |
| 463 | NC | NC | NC | NC | | | | | NC | NC | NC |
| 464 | NC | NC | NC | NC | | | | | NC | NC | NC |
| 465 | | | NC | | | | | | | | NC |
| 469 | NC | NC | NC | NC | | | | | NC | NC | NC |
| 473 | NC | NC | NC | NC | | | | | NC | NC | NC |
| 478 | NC | NC | NC | NC | | | | | NC | NC | NC |
| 479 | C | C | C* | C | | | | | NC | NC | NC |
| 481 | C | NC | NC | NC | | | | | NC | NC | NC |
| 483 | C | C | NC | C | | | | | NC | NC | NC |
| 486 | NC | NC | NC | NC | | | | | NC | NC | NC |
| 488 | NC | NC | NC | NC | | | | | NC | NC | NC |
| 489 | NC | NC | NC | NC | | | | | NC | NC | NC |
| 491 | NC | NC | NC | NC | | | | | NC | NC | NC |
| 493 | C | NC | C* | C | | | | | NC | NC | NC |
| 495 | NC | NC | NC | NC | | | | | NC | NC | NC |
| 499 | C | NC | C* | C | | | | | NC | NC | NC |
| 500 | NC | NC | NC | NC | | | | | NC | NC | NC |
| 502 | C | NC | NC | C | | | | | NC | NC | NC |
| 506 | NC | NC | NC | NC | | | | | NC | NC | NC |
| 511 | NC | NC | NC | NC | | | | | NC | NC | NC |
| 513 | NC | NC | NC | NC | | | | | NC | NC | NC |
| 518 | NC | NC | NC | NC | | | | | NC | NC | NC |

TABLE 3-2-continued

Epitope Binning

| | Positive controls S1 NTD | | | | | | | | Negative controls | | |
|---|---|---|---|---|---|---|---|---|---|---|---|
| Antibody ID | S652-19 | S652-22 | S652-102 | S652-118 | 419 | 1075 | 1130 | 4A8 | S652-123 | 8203-C1 | PA1-983 |
| 519 | | | NC | | | | | | | | NC |
| 520 | | | NC | | | | | | | | NC |
| 525 | NC | NC | NC | NC | | | | | NC | NC | NC |
| 528 | NC | NC | NC | NC | | | | | NC | NC | NC |
| 530 | NC | NC | NC | NC | | | | | NC | NC | NC |
| 534 | | | NC | | | | | | | | NC |
| 535 | | | NC | | | | | | | | NC |
| 539 | NC | NC | NC | NC | | | | | NC | NC | NC |
| 540 | NC | NC | C | NC | | | | | NC | NC | NC |
| 552 | NC | NC | NC | NC | | | | | NC | NC | NC |
| 554 | NC | NC | NC | NC | | | | | NC | NC | NC |
| 555 | NC | NC | NC | NC | NC | NC | NC | NC | | | |
| 557 | NC | NC | NC | NC | | | | | NC | NC | NC |
| 558 | NC | NC | NC | NC | | | | | NC | NC | NC |
| 561 | NC | NC | NC | NC | | | | | NC | NC | NC |
| 562 | C | NC | C | C | | | | | NC | NC | NC |
| 567 | NC | NC | NC | NC | | | | | NC | NC | C |
| 574 | NC | NC | NC | NC | | | | | NC | NC | NC |
| 575 | C | NC | C | C | | | | | NC | NC | NC |
| 585 | NC | NC | NC | NC | | | | | NC | NC | NC |
| 851 | NC | NC | NC | NC | NC | NC | | | | | |
| 894 | NC | NC | NC | NC | C | C | C | | | | |
| 896 | NC | NC | NC | NC | NC | NC | NC | | | | |
| 923 | NC | NC | NC | NC | NC | NC | NC | NC | | | |
| 936 | NC | NC | NC | NC | NC | NC | NC | | | | |
| 970 | NC | NC | NC | NC | NC | NC | NC | | | | |
| 1015 | NC | NC | NC | NC | NC | NC | | | | | |
| 1036 | NC | NC | NC | NC | NC | NC | NC | | | | |
| 1037 | NC | NC | NC | NC | NC | NC | NC | NC | | | |
| 1075 | NC | NC | NC | NC | C | C | C | C | | | |
| 1135 | NC | NC | NC | NC | NC | NC | NC | | | | |
| 1139 | | NC | NC | | | NC | NC | | | | |
| 1149 | | NC | NC | | | NC | NC | | | | |
| 1404 | NC | NC | NC | NC | NC | NC | NC | | | | |
| 1444 | NC | NC | NC | NC | NC | NC | NC | | | | |
| 1495 | | NC | NC | | | NC | | | | | |
| 1538 | | | | | | | | | | | |
| 1585 | | NC | NC | | | NC | | | | | |

TABLE 3-3

Epitope Binning

| | Positive controls S1 RBD | | | | | | | | | |
|---|---|---|---|---|---|---|---|---|---|---|
| Antibody ID | S652-109 | S652-115 | 294 | 422 | 488 | 555 | 923 | 1037 | 1081 | 488 Combo |
| 258 | NC | NC | | | | | | | | |
| 261 | NC | NC | | | | | | | | |
| 269 | NC | | | | | | | | | |
| 275 | NC | NC | | | | | | | | |
| 277 | NC | NC | | | | | | | | |
| 283 | NC | NC | | | | | | | | |
| 285 | NC | NC | | | | | | | | |
| 291 | NC | NC | | | | | | | | |
| 297 | NC | NC | | | | | | | | |
| 298 | NC | NC | | | | | | | | |
| 302 | NC | NC | | | | | | | | |
| 308 | NC | NC | | | | | | | | |
| 309 | NC | NC | | | | | | | | |
| 310 | NC | NC | | | | | | | | |
| 311 | NC | NC | | | | | | | | |
| 313 | C | NC | | | | | | | | |
| 318 | NC | | | | | | | | | |
| 325 | NC | | | | | | | | | |
| 336 | NC | NC | | | | | | | | |
| 338 | NC | NC | | | | | | | | |
| 350 | NC | NC | | | | | | | | |

TABLE 3-3-continued

Epitope Binning

| | | | | | | | | | | |
|---|---|---|---|---|---|---|---|---|---|---|
| 353 | NC | NC | | | | | | | | |
| 356 | NC | NC | | | | | | | | |
| 357 | NC | NC | | | | | | | | |
| 358 | NC | NC | | | | | | | | |
| 359 | NC | NC | | | | | | | | |
| 360 | NC | NC | | | | | | | | |
| 361 | NC | NC | | | | | | | | |
| 369 | NC | NC | | | | | | | | |
| 370 | NC | | | | | | | | | |
| 381 | NC | NC | | | | | | | | |
| 388 | NC | NC | | | | | | | | |
| 389 | NC | NC | | | | | | | | |
| 390 | NC | NC | | | | | | | | |
| 391 | NC | NC | | | | | | | | |
| 393 | NC | NC | | | | | | | | |
| 394 | NC | NC | | | | | | | | |
| 397 | NC | NC | | | | | | | | |
| 400 | NC | NC | | | | | | | | |
| 402 | NC | NC | | | | | | | | |
| 408 | C | | | | | | | | | |
| 413 | NC | NC | | | | | | | | |
| 415 | NC | NC | | | | | | | | |
| 417 | NC | NC | | | | | | | | |
| 419 | NC | | | | | | | | | |
| 428 | NC | NC | | | | | | | | |
| 429 | NC | NC | | | | | | | | |
| 441 | NC | NC | | | | | | | | |
| 442 | NC | | | | | | | | | |
| 447 | NC | NC | | | | | | | | |
| 449 | NC | NC | | | | | | | | |
| 453 | NC | NC | | | | | | | | |
| 455 | NC | NC | | | | | | | | |
| 458 | NC | NC | | | | | | | | |
| 459 | NC | | | | | | | | | |
| 460 | NC | | | | | | | | | |
| 461 | NC | NC | | | | | | | | |
| 462 | NC | | | | | | | | | |
| 463 | NC | NC | | | | | | | | |
| 464 | NC | NC | | | | | | | | |
| 465 | NC | | | | | | | | | |
| 469 | NC | NC | | | | | | | | |
| 473 | NC | NC | | | | | | | | |
| 478 | NC | NC | | | | | | | | |
| 479 | NC | NC | | | | | | | | |
| 481 | NC | NC | | | | | | | | |
| 483 | NC | NC | | | | | | | | |
| 486 | NC | NC | | | | | | | | |
| 488 | C | NC | | | | | | | | |
| 489 | NC | NC | | | | | | | | |
| 491 | NC | NC | | | | | | | | |
| 493 | NC | NC | | | | | | | | |
| 495 | NC | NC | | | | | | | | |
| 499 | NC | NC | | | | | | | | |
| 500 | NC | NC | | | | | | | | |
| 502 | NC | NC | | | | | | | | |
| 506 | NC | NC | | | | | | | | |
| 511 | NC | NC | | | | | | | | |
| 513 | NC | NC | | | | | | | | |
| 518 | NC | NC | | | | | | | | |
| 519 | NC | | | | | | | | | |
| 520 | NC | | | | | | | | | |
| 525 | NC | NC | | | | | | | | |
| 528 | NC | NC | | | | | | | | |
| 530 | NC | NC | | | | | | | | |
| 534 | NC | | | | | | | | | |
| 535 | NC | | | | | | | | | |
| 539 | NC | NC | | | | | | | | |
| 540 | NC | NC | | | | | | | | |
| 552 | NC | NC | | | | | | | | |
| 554 | NC | NC | | | | | | | | |
| 555 | NC | NC | C | C | NC | C | NC | NC | NC | C |
| 557 | NC | NC | | | | | | | | |
| 558 | NC | NC | | | | | | | | |
| 561 | NC | NC | | | | | | | | |
| 562 | NC | NC | | | | | | | | |
| 567 | NC | NC | | | | | | | | |
| 574 | NC | NC | | | | | | | | |
| 575 | NC | NC | | | | | | | | |

TABLE 3-3-continued

| Epitope Binning | | | | | | | | | | |
|---|---|---|---|---|---|---|---|---|---|---|
| 585 | NC | NC | | | | | | | | |
| 851 | NC | NC | NC | NC | | NC | NC | NC | NC | |
| 894 | NC | NC | NC | NC | | NC | NC | NC | NC | |
| 896 | NC | NC | NC | NC | | NC | NC | NC | NC | |
| 923 | NC | NC | C | C | C | NC | C | NC | NC | C |
| 936 | NC | NC | NC | NC | | C | NC | C | NC | |
| 970 | NC | NC | NC | NC | | NC | C | NC | NC | |
| 1015 | NC | NC | NC | NC | | NC | NC | NC | NC | |
| 1036 | NC | NC | NC | C | | C | NC | C | NC | |
| 1037 | NC | NC | NC | C | NC | NC | NC | C | NC | NC |
| 1075 | NC | NC | NC | NC | NC | NC | NC | NC | NC | NC |
| 1135 | C | NC | NC | C | | C | NC | C | C | |
| 1139 | NC | | NC | C | | C | NC | NC | NC | |
| 1149 | NC | | NC | C | | C | NC | C | NC | |
| 1404 | NC | | | | NC | NC | NC | C | NC | |
| 1444 | NC | | | | C | NC | C | C | NC | |
| 1495 | NC | | | | NC | NC | NC | NC | NC | |
| 1538 | | | | | | | | | | |
| 1585 | C | | | | NC | NC | NC | NC | C | |

| | Positive controls | | | | | | | | | |
|---|---|---|---|---|---|---|---|---|---|---|
| | S1 RBD | | | | | | S2 | | | |
| Antibody ID | CR3022 | CA1 | CB6 | REGN 10933 | REGN 10987 | VIR S309 | S562-103 | S562-112 | S562-116 | 1193 |
| 555 | | C | C | C | NC | NC | NC | NC | NC | NC |
| 851 | | | | | | | NC | NC | NC | NC |
| 894 | | | | | | | NC | NC | NC | NC |
| 896 | | | | | | | NC | NC | NC | NC |
| 923 | C | C | C | C | NC | NC | NC | NC | NC | NC |
| 936 | | | | | | | NC | NC | NC | NC |
| 970 | | | | | | | NC | NC | NC | NC |
| 1015 | | | | | | | NC | NC | NC | NC |
| 1036 | | | | | | | NC | NC | NC | NC |
| 1037 | NC | NC | NC | NC | C | C | NC | NC | NC | NC |
| 1075 | NC | NC | NC | NC | NC | NC | NC | NC | NC | NC |
| 1135 | | | | | | | NC | NC | NC | NC |
| 1139 | | | | | | | NC | NC | NC | NC |
| 1149 | | | | | | | NC | NC | NC | NC |
| 1404 | NC | | | | | | NC | NC | NC | NC |
| 1444 | NC | | | | | | NC | NC | NC | NC |
| 1495 | NC | | | | | | NC | NC | NC | NC |
| 1538 | | | | | | | | | | |
| 1585 | NC | | | | | | NC | NC | NC | NC |

Example 4

Epitope Binning, ACE2 Blocking and Binding Kinetics of Selected mAbs

A CARTERRA® LSA™ instrument, a fully integrated HT-SPR™ (high throughput surface plasmon resonance) system, was used for premix epitope binning, ACE2 blocking assay, and binding kinetics measurement of selected anti-SARS-CoV-2 mAbs colony-cloned from CHO cells. The assays were performed according to the manufacturer's brochure. The reagents used in the experiments are shown in Table 4-1.

TABLE 4-1

| Reagents | | |
|---|---|---|
| Name | Provider | Catalog No. |
| Recombinant Human ACE2 | R&D Systems | 933-ZN-010 |
| 2019 nCoV Spike Protein (RBD, His tag) | Sino Biological | 40592-V08H |
| SARS-CoV-2 (2019-nCoV) Spike protein (S2 ECD, His Tag) | Sino Biological | 40590-V08B |
| NCP-CoV (2019-nCoV) Spike Protein (S1 Subunit, His Tag) | Sino Biological | 40591-V08H |
| nCoV-5 Spike Protein Trimer | NIH | N/A |
| Dextran NSB Reducer | GE Health Sciences | BR100691 |
| Heparin Sodium Salt | Fisher | BP2425 |

The instrument uses a multi-channel buffer of 25 mM MES at pH 5.5, and a single-channel buffer of 1×HBSEP+. HC30M chips were used and the array preparation was performed according to the CARTERRA® protocol, including chip activation for 7 minutes in activation buffer (100 μL ECD+100 μL sNHS+100 μL 25 mM MES pH 5.5), coupling to samples in 10 mM acetate (pH 4.0) for 10 minutes, and deactivation for 7 minutes in 1M ethanolamine (pH 8.5).

For premix epitope binning, 20 nM of SARS-CoV-2 Spike protein was premixed with 200 nM of the mAb diluted in 1×HBSEP with 0.1 mg/mL BSA, and incubated for a minimum of 3 hours. The complex of Spike protein/mAb was then tested for binding to the immobilized mAbs on the prepared HC30M chips, with association for 5 minutes and dissociation for 1 minute. Regeneration was performed in 20 mM glycine (pH 2.0) with 1M NaCl for 45 seconds twice.

To test the mAbs' ability to block ACE2, antibodies coupled to the HC-30M chip as described above were exposed to SARS-CoV-2 Spike protein:ACE2 complex. 20 nM of SARS-CoV-2 Spike protein was premixed with 200 nM of the His-tagged ACE2 (ACE2-His) or untagged ACE2 diluted in either 1×HBSEP with 0.5M NaCl, 1% BSA, 1× Dextran, and 2 mg/mL Heparin or HBSTE and 0.05% BSA. The complex of Spike protein/ACE2-His was then tested for binding to the immobilized mAbs on the prepared HC-30M chips, with association for 5 minutes and dissociation for 1 to 5 minutes. A SARS-CoV-2 Spike protein injection at 20 nM was included to assess for maximum binding, as well as a ACE2 injection at 200 nM to assess for non-specific binding. Regeneration was performed in 20 mM glycine pH 2.0 with 1M NaCl for 30 seconds twice.

The data were analyzed using the CARTERRA® Epitope analysis software (version 1.2.0.1960). For each ligand, the analyte binding signals were normalized to the SARS-CoV-2 Spike-only binding signal, such that the Spike-only signal average is equivalent to one RU (relative unit). A threshold window ranging from 0.7 RU to 0.71 RU was used to classify analytes into 2 categories: ACE2 blockers (analytes with a binding signal under the lower limit threshold) and non-blockers (analytes with a binding signal over the higher limit threshold). Antibodies with low coupling to the chip, poor regeneration, or non-specific binding to ACE2 were excluded in the analysis.

To test binding kinetics, the prepared HC30M chips were tested against SARS-CoV-2 Spike protein with titration beginning at 200 nM with three-fold serial dilutions, with association for 5 minutes and dissociation for 20 minutes. Regeneration was performed in 20 mM glycine (pH 2.0) with 1M NaCl for 45 seconds twice. For the domain-specific protein (RBD, S2 or S1 subunit), the tested concentrations were 500 nM, 250 nM, and 125 nM. The test was performed at either 25° C. or 37° C. Tables 4-2 and 4-3 summarize the epitope bin, binding kinetics, neutralization, and ACE2-blocking activities of select mAbs.

TABLE 4-2

Epitope bins, binding kinetics, and ACE2-blocking activities of selected mAbs

| mAb ID | Epitope Bin | ACE2-block? | $K_D$ (M) - 25° C. | $k_d$ (M) - 25° C. | $K_D$ (M) - 37° C. | $k_d$ (M) - 37° C. | S1 $K_D$ 25° C. | RBD $K_D$ 25° C. |
|---|---|---|---|---|---|---|---|---|
| 292 | 1 | Y | 6.08E−11 | 3.09E−05 | 7.86E−11 | 8.64E−05 | 1.18E−07 | 6.78E−09 |
| 309 | 2 | N | 1.58E−11 | 8.34E−06 | 3.31E−11 | 3.08E−05 | | |
| 364 | 3 | N | 7.61E−09 | 2.80E−04 | 2.33E−11 | 1.00E−05 | | |
| 373 | 2 | Y | 1.07E−08 | 4.81E−04 | 3.70E−11 | 1.00E−05 | | |
| 388 | 2 | N | 1.63E−11 | 8.61E−06 | 4.47E−11 | 4.71E−05 | | |
| 408 | 2 | Y | 1.74E−11 | 1.03E−06 | 5.58E−11 | 1.24E−05 | 1.71E−07 | |
| 414 | N/A | N | 7.93E−09 | 1.52E−04 | 5.21E−09 | 8.84E−04 | | |
| 417 | 1 | Y | 2.14E−11 | 1.02E−05 | 1.96E−10 | 1.03E−04 | 7.50E−07 | |
| 419 | 2 | N | 3.78E−10 | 1.04E−05 | 1.25E−09 | 7.75E−04 | 2.35E−07 | |
| 442 | 4 | N | 1.76E−08 | 1.74E−04 | 1.01E−09 | 2.95E−05 | | |
| 445 | 2 | N | 1.20E−09 | 1.90E−05 | 4.17E−10 | 1.27E−04 | 6.13E−07 | |
| 447 | 1 | Y | 1.10E−10 | 3.74E−05 | 2.60E−10 | 1.62E−04 | 1.48E−07 | 4.38E−09 |
| 462 | 5 | N | 7.58E−09 | 1.95E−04 | 4.62E−09 | 3.42E−04 | | |
| 479 | 6 | Y | 5.59E−11 | 1.61E−05 | 2.86E−11 | 1.00E−05 | 4.20E−07 | |
| 481 | 1 | Y | 1.18E−10 | 2.62E−05 | 2.34E−10 | 8.99E−05 | 1.70E−07 | 1.41E−08 |
| 483 | 6 | Y | 5.27E−11 | 1.48E−05 | 2.33E−10 | 7.95E−05 | | |
| 488 | 1 | Y | 5.26E−11 | 4.15E−06 | 4.76E−10 | 7.61E−05 | 3.65E−08 | 1.51E−08 |
| 494 | 1 | Y | 8.35E−11 | 1.38E−05 | 2.25E−10 | 9.08E−05 | 1.89E−07 | 1.35E−08 |
| 506 | 1 | Y | 4.91E−11 | 2.06E−05 | 6.93E−11 | 7.68E−05 | 9.09E−08 | 1.47E−08 |
| 540 | 4 | N | 1.22E−10 | 1.18E−05 | 9.05E−10 | 1.18E−04 | | |
| 549 | 1 | Y | 2.57E−13 | 2.03E−08 | 5.00E−10 | 7.27E−05 | 4.14E−08 | 1.39E−08 |
| 553 | 1 | Y | 1.31E−10 | 9.50E−06 | 3.57E−10 | 6.70E−05 | 1.53E−07 | |
| 555 | 7 | Y | 2.44E−11 | 1.63E−05 | 5.77E−11 | 6.34E−05 | 7.97E−09 | 4.13E−09 |
| 562 | 4 | N | 1.73E−10 | 4.97E−05 | 1.38E−10 | 5.77E−05 | | |
| 851 | | N | | | | | | |
| 894 | | N | | | | | | |
| 896 | | N | | | | | | |
| 923 | | Y | | | | | | |
| 936 | | Y | | | | | | |
| 970 | | Y | | | | | | |
| 1015 | | Y | | | | | | |
| 1036 | | N | | | | | | |
| 1037 | | Y | | | | | | |
| 1075 | | N | | | | | | |
| 1135 | | N | | | | | | |
| 1139 | | Y | | | | | | |
| 1149 | | N | | | | | | |
| 1404 | | Y | | | | | | |
| 1444 | | Y | | | | | | |
| 1495 | | Y | | | | | | |
| 1538 | | Y | | | | | | |
| 1585 | | Y | | | | | | |

TABLE 4-3

| Epitope Bin | mAb Properties |
|---|---|
| 1 | ACE2 blocking, RBD or NTD binder |
| 2 | S1 or S2 (not RBD) binder, some may block ACE2 |
| 3 | S2 binder |
| 4 | S2 binder |
| 5 | S2 binder |
| 6 | S1 or S2 (not RBD), but ACE2 blocking |
| 7 | RBD Binder (bins with VRC RBD Benchmark), ACE2 blocking |

Example 5

Biophysical Characterization of Selected mAbs
Materials and Methods mAbs were subjected to several biophysical characterizations including analytical size exclusion chromatography (SEC-HPLC), hydrophobic interaction chromatography-high performance liquid chromatography (HIC-HPLC), heparin chromatography (Heparin-HPLC), cross-interaction chromatography (CIC), and affinity-capture self-interaction nanoparticle spectroscopy (AC-SINS). See Table 5-1.

SEC-HPLC

4 µg of samples were injected onto a Waters BEH200 SEC, 4.6×150 mm, 1.7 µm column (Waters Cat #186005225). A flow rate of 0.3 mL/min with the running buffer containing 50 mM sodium phosphate, pH 6.8, 0.3M NaCl, 0.005% sodium azide was used. UV absorbance was monitored at 280 nm using an Agilent 1260 HPLC. Retention time (RT) of main peak and percentage of monomer are reported.

HIC-HPLC

20 µg IgG samples (1 mg/mL) were diluted 1:1 with 2× Buffer A concentrate (2 M ammonium sulfate, 0.1 M sodium phosphate at pH 6.8) to achieve a final ammonium sulfate concentration of 1 M before analysis. A TSKGEL® butyl-NPR (4.6 mm ID×10 cm, 2.5 µm, Tosoh #42168) column was used with a linear gradient (0-100% buffer B) of mobile phase A (1M ammonium sulfate, 50 mM sodium phosphate, pH 6.8) and mobile phase B solution (50 mM sodium phosphate, pH 6.8) over 23 min at a flow rate of 1 mL/min with UV absorbance monitoring at 280 nm. Retention time of main peak is reported.

Heparin-HPLC

20 µg of IgG samples (1 mg/mL) in PBS was injected onto a POROS™ Heparin 50 um (4.6×50 mm, 0.8 mL, Thermo Scientific #4333412) column. Flow was kept at 1.5 mL/mL with an initial linear gradient from 0% buffer B to 40% buffer B in 6 minutes then up to 60% B in 2 minutes, followed by a 1 minute gradient increase to 100% B. Gradient was kept at 100% for an additional minute to remove any remaining protein. Retention time of main peak is reported.

CIC

CIC was performed as described previously (Jacobs, S. A., et al., Pharm. Res. 27, 65-71, 2010). In brief, the CIC column was prepared by coupling ~30 mg of human serum polyclonal antibodies (14506; Sigma) to a 1-mL HITRAP® column (17-0716-01; GE Healthcare), followed by quenching with ethanolamine. The blank column was prepared in the same except without human serum IgGs. Approximately 20 µg of each antibody was tested at a flow rate of 0.2 mL/min using 10 mM sodium citrate, 10 mM NaCl, pH 6.5 as a mobile phase on an Agilent 1260 series HPLC system. Retention times obtained by both IgG and blank columns were used to calculate k'. In addition, due to peak tailing in some samples, peak width at 50% height is also obtained to monitor non-specific interaction of test antibodies.

AC-SINS

The AC-SINS assay was performed as described previously with modifications (Wu, J. et al., Protein Eng. Des. Sel. 28, 403-14, 2015). In short, gold nanoparticles (15705; Ted Pella Inc.) were coated with 100% capturing anti-human goat IgG Fc (109-005-008; Jackson ImmunoResearch). The conjugation reaction was quenched with 1 µg/mL polyethylene glycol (PEG) and eluted into 0.25×PBS. PEG was added to the conjugated gold mixture at a concentration of 0.2 µg/mL prior to use. The antibodies of interest were then incubated with the coated gold particles for 1 h at room temperature and the wavelength shift was measured using Tecan M1000 Pro Plate Reader within the range of 475-625 nm, in increments of 1 nm. Test antibodies were diluted in either PBS or 10 mM histidine, pH 6.0 prior to incubation. Delta plasma wavelength shift in comparison with buffer control is reported. The self-interacting antibodies show a higher wavelength shift away from the buffer controls.

TABLE 5-1

Biophysical properties of selected mAbs

| Antibody ID | aSEC RT (min) | aSEC % monomer | HIC RT (min) | HepSO4 RT (min) | CIC RT (min) (IgG) | CIC RT (min) (Blank) | CIC k' | CIC Peak Width 50% | AC-SINS H6N30 (Delta pwl) | AC-SINS PBS (Delta pwl) |
|---|---|---|---|---|---|---|---|---|---|---|
| 292 | 4 | 92.7 | 3 | 2.0 | 4.8 | 4.3 | 0.09 | 1.7 | −3.0 | 0.0 |
| 309 | 4.1 | 87.3 | 5.3 | 2.1 | 4.6 | 4.3 | 0.07 | 1.5 | −3.0 | 0.0 |
| 364 | 6.4 | 79.5* | 18.6 | 2.2 | 6.6 | 5.6 | 0.2 | 3.5 | 3.0 | 3.0 |
| 373 | 4.6 | 90.3 | 17.0 | 1.3 | 5.6 | 5.8 | −0.04 | 2.5 | 0.0 | 1.0 |
| 388 | 4.1 | 91.6 | 1.9 | 3.3 | 4.9 | 4.4 | 0.13 | 1.4 | 0.0 | 1.0 |
| 408 | 4.9 | 92 | 15.2 | 2.2 | 5.2 | 4.8 | 0.1 | 2.1 | 1.0 | 3.0 |
| 414 | 8.2 | 97.4 | 25.9 | 1.9 | 7.5 | 6.1 | 0.23 | 3.7 | 5.0 | 8.0 |
| 417 | 4.8 | 96 | 11.7 | 1.6 | 4.6 | 4.4 | 0.05 | 1.5 | −3.0 | 0.5 |
| 419 | 4 | 94 | 9.1 | 0.4 | 5.3 | 4.7 | 0.12 | 2.2 | 21.0 | 2.3 |
| 442 | 4.1 | 90.4 | 5.1 | 2.0 | 4.6 | 4.3 | 0.06 | 1.5 | −3.0 | 0.0 |
| 445 | 3.9 | 88.4 | 6.5 | 0.4 | 4.7 | 4.5 | 0.06 | 1.5 | 7.0 | 0.0 |
| 447 | 4.1 | 92.6 | 2.2 | 2.3 | 4.9 | 4.4 | 0.12 | 1.6 | −3.0 | 0.0 |
| 462 | 4.3 | 93.6 | 9.1 | 1.8 | 4.7 | 4.4 | 0.05 | 1.5 | −3.0 | 1.0 |
| 479 | 5.5 | 75.8 | 8.5 | 1.7 | 4.6 | 4.4 | 0.05 | 1.5 | −3.0 | 0.8 |
| 481 | 4.2 | 91.3 | 9.4 | 1.6 | 4.7 | 4.4 | 0.09 | 1.7 | −3.0 | 0.0 |

TABLE 5-1-continued

Biophysical properties of selected mAbs

| Antibody ID | aSEC RT (min) | aSEC % monomer | HIC RT (min) | HepSO4 RT (min) | CIC RT (min) (IgG) | CIC RT (min) (Blank) | CIC k' | CIC Peak Width 50% | AC-SINS H6N30 (Delta pwl) | AC-SINS PBS (Delta pwl) |
|---|---|---|---|---|---|---|---|---|---|---|
| 483 | 3.9 | 94.4 | 5.7 | 0.3 | 4.5 | 4.3 | 0.03 | 1.4 | −0.5 | 0.0 |
| 488 | 4 | 92.6 | 5.7 | 1.4 | 4.7 | 4.5 | 0.04 | 1.6 | −2.0 | 0.0 |
| 494 | 4 | 90.7 | 5.9 | 1.5 | 4.6 | 4.3 | 0.05 | 1.6 | −3.0 | 0.0 |
| 506 | 4 | 88.4 | 6.4 | 1.5 | 4.3 | 4.4 | −0.02 | 1.4 | −3.0 | 0.0 |
| 540 | 4 | 92 | 1.8 | 2.4 | 4.8 | 4.3 | 0.1 | 1.5 | −2.0 | 0.3 |
| 549 | 4.2 | 89.1 | 13.8 | 2.1 | 5.2 | 4.7 | 0.1 | 2.7 | N/A | N/A |
| 553 | 4.1 | 85.3 | 7.2 | 2.1 | 4.7 | 4.4 | 0.08 | 1.5 | −3.0 | 1.0 |
| 555 | 5 | 97.8 | 10.7 | 2.5 | 5.1 | 4.5 | 0.12 | 2.2 | 0.5 | 1.0 |
| 562 | 4.1 | 91.9 | 6.6 | 1.8 | 4.6 | 4.4 | 0.05 | 1.5 | −3.0 | 0.0 |

Example 6

Pseudoneutralization Assays

A variety of pseudoneutralization assays were performed for various anti-coronavirus antibodies. In some experiments, pseudoneutralization assays were performed using four concentrations of antibodies. Antibody dilutions were premixed with pseudotyped lentivirus expressing the SARS-CoV-2 full-length Spike protein and incubated with 293T cells transiently expressing human ACE2 receptor for 72 hours. Cells were lysed and viral entry into cells was quantified by Promega Luciferase assay kit using a plate reader. % neutralization at each concentration was calculated by comparison to virus only (0% neutralization) and cell only (100% neutralization) control wells (see Table 6-1). All assays were run in duplicate. Benchmark mAb S652-118 and immunized mouse serum were used as positive controls, using seven titration points to calculate $IC_{50}$, $IC_{80}$ and $IC_{90}$ values (see Tables 6-2 and 6-3). Sigmoidal curves were generated and $IC_{50}$ and $IC_{80}$ values were calculated as the concentration of antibody required to neutralize 50% and 80% of the virus, respectively (see Table 6-4). Antibodies for which a curve could not be fit are indicated as having an $IC_{50}$ value of >50 µg/mL.

TABLE 6-1

Four-point Pseudoneutralization screen of monoclonal antibodies % Neutralization

| Antibody ID | 50 µg/mL | 10 µg/mL | 1 µg/mL | 0.1 µg/mL | 0.01 µg/mL |
|---|---|---|---|---|---|
| 258 |  | 6 | 33 | 3 | 11 |
| 259 | 0 | 0 | 0 | 0 |  |
| 260 |  | 12 | 16 | 23 |  |
| 261 |  | 9 | 7 | −6 | 12 |
| 262 |  | 16 | 8 | 8 | 1 |
| 263 | 0 | 0 | 12 | 5 |  |
| 264 | 0 | 26 | 41 | 42 |  |
| 265 | 5 | 0 | 20 | 22 |  |
| 266 | 23 | 18 | 31 | 38 |  |
| 267 | 9 | 0 | 0 | 0 |  |
| 268 |  | 33 | −1 | −2 | 2 |
| 269 |  | 7 | 10 | −4 | −4 |
| 270 | 0 | 0 | 0 | 0 |  |
| 271 | 10 | 6 | 22 | 29 |  |
| 272 |  | −3 | −6 | −8 | −4 |
| 273 | 16 | 0 | 0 | 0 |  |
| 274 |  | 5 | 5 | 25 | 13 |
| 274 | 38 | 8 | 3 | 0 |  |
| 275 |  | 13 | −12 | −2 | −5 |
| 276 | 44 | 50 | 10 | 17 |  |
| 277 |  | −1 | 7 | 18 | 22 |
| 278 |  | −6 | −13 | −17 | −27 |
| 279 |  | 18 | 20 | 10 | 6 |
| 280 |  | 18 | −4 | −12 | −19 |
| 281 | 9 | 0 | 0 | 5 |  |
| 282 |  | 4 | 18 | 26 | 31 |
| 283 |  | 10 | 15 | 21 | 22 |
| 284 | 0 | 0 | 0 | 0 |  |
| 285 |  | 1 | −15 | −32 | −16 |
| 287 |  | 7 | 19 | −8 | −3 |
| 288 | 0 | 0 | 0 | 0 |  |
| 289 | 25 | 0 | 0 | 18 |  |
| 290 |  | 0 | 19 | 14 |  |
| 291 |  | 24 | 16 | −1 | 5 |
| 292 |  | 60 | 1 | −2 | 6 |
| 293 |  | −10 | 15 | −7 | −3 |
| 294 | 83 | 80 | 56 | 37 |  |
| 295 | 33 | 5 | 0 | 29 |  |
| 296 |  | 10 | 7 | −15 | 0 |
| 297 |  | −17 | 7 | 15 | 11 |
| 298 |  | 15 | 2 | 29 | 18 |
| 299 | 36 | 13 | 9 | 34 |  |
| 300 | 40 | 14 | 0 | 13 |  |
| 301 | 0 | 0 | 0 | 2 |  |
| 302 |  | 24 | 10 | 38 | 23 |
| 303 | 0 | 0 | 0 | 0 |  |
| 304 |  | −11 | 6 | 12 | 16 |
| 305 |  | 16 | 6 | 7 | 12 |
| 306 | 0 | 0 | 0 | 0 |  |
| 308 |  | 19 | 13 | −14 | 2 |
| 309 |  | −19 | −10 | 32 | 30 |
| 310 |  | 9 | 2 | 5 | −14 |
| 311 |  | −15 | −7 | 39 | 33 |
| 312 |  | 10 | 11 | −1 | 18 |
| 313 |  | 8 | 10 | −3 | 13 |
| 314 |  | −3 | 4 | −16 | 4 |
| 315 | 21 | 22 | 22 | 0 |  |
| 316 | 36 | 32 | 35 | 25 |  |
| 317 | 39 | 30 | 28 | 20 |  |
| 318 |  | 26 | −12 | 11 | 13 |
| 319 | 45 | 39 | 34 | 36 |  |
| 320 | 96 | 93 | 68 | 22 |  |
| 321 |  | 13 | 7 | −2 | 34 |
| 322 |  | 18 | 3 | −17 | −20 |
| 323 | 0 | 0 | 0 | 16 |  |
| 324 | 47 | 44 | 33 | 33 |  |
| 325 |  | 24 | 14 | 5 | 10 |
| 326 | 31 | 24 | 21 | 0 |  |
| 327 | 26 | 22 | 15 | 12 |  |
| 328 | 0 | 0 | 0 | 0 |  |
| 329 | 0 | 0 | 20 | 10 |  |
| 330 |  | 23 | 22 | 18 | 16 |
| 331 | 0 | 0 | 0 | 1 |  |

TABLE 6-1-continued

Four-point Pseudoneutralization screen of monoclonal antibodies
% Neutralization

| Antibody ID | 50 μg/mL | 10 μg/mL | 1 μg/mL | 0.1 μg/mL | 0.01 μg/mL |
|---|---|---|---|---|---|
| 332 | 0 | 0 | 3 | 0 | |
| 333 | 0 | 0 | 0 | 0 | |
| 334 | | 20 | 18 | 7 | 14 |
| 335 | | −19 | −7 | 33 | 33 |
| 335 | 14 | 0 | 0 | 0 | |
| 336 | | 14 | 19 | 12 | 16 |
| 337 | 28 | 0 | 11 | 11 | |
| 338 | | 26 | 22 | 11 | 18 |
| 339 | 0 | 0 | 24 | 7 | |
| 340 | 0 | 0 | 0 | 6 | |
| 341 | | −25 | −23 | 37 | 23 |
| 342 | 0 | 0 | 21 | 17 | |
| 343 | 0 | 8 | 17 | 27 | |
| 344 | 27 | 32 | 38 | 24 | |
| 345 | 37 | 0 | 0 | 0 | |
| 347 | 12 | 32 | 24 | 16 | |
| 348 | 41 | 19 | 17 | 0 | |
| 349 | 0 | 8 | 0 | 0 | |
| 350 | | 17 | 9 | −10 | −23 |
| 351 | 37 | 31 | 1 | 0 | |
| 352 | | 22 | 16 | 16 | 19 |
| 353 | | 1 | 16 | −1 | −4 |
| 354 | | 10 | 21 | 9 | 4 |
| 355 | | 3 | 11 | 15 | −3 |
| 356 | | 10 | 6 | −9 | 2 |
| 357 | | 13 | 6 | 9 | 2 |
| 358 | | 19 | 15 | 3 | 17 |
| 359 | | 14 | 20 | 2 | −14 |
| 360 | | 25 | 13 | −12 | 2 |
| 361 | | 17 | 1 | 2 | 6 |
| 362 | 0 | 0 | 0 | 0 | |
| 363 | 0 | 0 | 0 | 2 | |
| 364 | 19 | 10 | −5 | 11 | |
| 365 | 26 | 17 | 5 | 21 | |
| 366 | 21 | 0 | 13 | 24 | |
| 367 | 15 | 2 | 0 | 0 | |
| 368 | | 10 | 24 | 20 | 21 |
| 370 | | 8 | 23 | 5 | 7 |
| 371 | | 7 | 21 | −2 | −4 |
| 372 | 5 | 0 | 0 | 0 | |
| 373 | | 60 | 37 | 25 | 15 |
| 374 | | 23 | 9 | −3 | 21 |
| 375 | 15 | 15 | 9 | 35 | |
| 376 | −4 | −4 | −2 | 2 | |
| 377 | 15 | −5 | −6 | −3 | |
| 378 | 0 | 0 | 0 | 0 | |
| 379 | 0 | 0 | 13 | 16 | |
| 380 | 30 | 10 | 29 | 40 | |
| 381 | | 10 | 19 | 24 | 27 |
| 382 | | 27 | 34 | 20 | 22 |
| 383 | | 0 | −3 | −7 | −5 |
| 384 | | 28 | 17 | 13 | 23 |
| 385 | 0 | 0 | 0 | 0 | |
| 387 | | 12 | 14 | 17 | 15 |
| 388 | | 19 | 32 | 49 | 36 |
| 389 | | −12 | 2 | −4 | −7 |
| 390 | | −4 | 3 | 8 | 8 |
| 391 | | −2 | −10 | −3 | −5 |
| 392 | 0 | 0 | 10 | 10 | |
| 393 | 10 | 21 | 40 | 25 | |
| 394 | 5 | 5 | 4 | −2 | |
| 395 | 14 | 0 | 31 | 34 | |
| 396 | 35 | 19 | 33 | 34 | |
| 397 | −1 | −5 | 11 | 6 | |
| 398 | 27 | 17 | 26 | 43 | |
| 399 | −8 | −13 | 23 | 7 | |
| 400 | −6 | −7 | 2 | 7 | |
| 401 | 0 | 4 | 9 | 4 | |
| 402 | 27 | 41 | 13 | 23 | |
| 403 | 22 | 12 | −23 | −7 | |
| 404 | −14 | −10 | −27 | −22 | |
| 405 | 23 | 22 | 15 | 22 | |
| 406 | 7 | 10 | 23 | 32 | |
| 407 | 19 | 25 | 41 | 34 | |
| 408 | 35 | 14 | 5 | −1 | |
| 409 | 25 | 17 | 33 | 13 | |
| 410 | 5 | −37 | 10 | 7 | |
| 412 | 93 | 99 | 22 | 23 | |
| 413 | 5 | 0 | −8 | 5 | |
| 414 | 32 | 36 | 26 | 41 | |
| 415 | 19 | 30 | −6 | 24 | |
| 416 | 0 | 0 | 16 | 19 | |
| 417 | 55 | 32 | 29 | 37 | |
| 418 | 3 | 13 | 0 | 3 | |
| 419 | 36 | 35 | 5 | 5 | |
| 420 | 3 | −2 | 7 | 24 | |
| 421 | 26 | 24 | 0 | 0 | |
| 422 | 91 | 87 | 82 | 18 | |
| 423 | 40 | 48 | 30 | 5 | |
| 424 | 8 | 13 | 12 | 29 | |
| 425 | 41 | 47 | 35 | 17 | |
| 426 | 21 | 24 | −3 | 9 | |
| 427 | 0 | 0 | 18 | 34 | |
| 428 | −11 | −4 | −14 | 26 | |
| 429 | −19 | −3 | −26 | −1 | |
| 431 | 46 | 45 | 33 | 16 | |
| 432 | 8 | −6 | 1 | −15 | |
| 433 | 14 | −9 | −6 | 18 | |
| 434 | 35 | 44 | 36 | 18 | |
| 435 | 2 | 0 | 0 | 47 | |
| 436 | 11 | 19 | 28 | 33 | |
| 437 | 0 | 0 | 0 | 0 | |
| 438 | −11 | −7 | 4 | 4 | |
| 439 | 25 | 17 | 0 | 0 | |
| 440 | 11 | 12 | −3 | 7 | |
| 441 | −17 | 8 | 13 | 24 | |
| 442 | 33 | 9 | 27 | 26 | |
| 443 | 31 | 0 | 0 | 16 | |
| 444 | 0 | 4 | 24 | 21 | |
| 445 | 38 | 12 | 9 | −9 | |
| 446 | 30 | 10 | 0 | 6 | |
| 447 | 87 | 22 | 15 | 35 | |
| 448 | 19 | 14 | 6 | −1 | |
| 449 | −4 | −12 | 1 | 2 | |
| 450 | 15 | −12 | 14 | 4 | |
| 451 | 5 | −13 | −10 | −21 | |
| 452 | 40 | 0 | 3 | 17 | |
| 453 | −12 | −6 | −18 | −19 | |
| 453 | 32 | 7 | 0 | 0 | |
| 454 | 37 | 17 | 25 | 15 | |
| 455 | 14 | 2 | 20 | 3 | |
| 456 | 0 | 0 | 0 | 0 | |
| 457 | −10 | −13 | −20 | −13 | |
| 458 | −29 | −14 | −18 | −17 | |
| 459 | 7 | 10 | −18 | −28 | |
| 460 | 16 | 3 | 21 | 32 | |
| 461 | −1 | 4 | 23 | 13 | |
| 462 | 40 | 9 | 6 | 38 | |
| 463 | 18 | 16 | 16 | 38 | |
| 464 | −6 | −10 | −2 | 11 | |
| 465 | −8 | 2 | 10 | 13 | |
| 467 | 3 | 9 | 20 | 23 | |
| 468 | 13 | 7 | 22 | 9 | |
| 469 | −1 | −10 | 1 | 7 | |
| 470 | 15 | 0 | 15 | 9 | |
| 471 | 41 | 0 | 0 | 10 | |
| 472 | −8 | −6 | 12 | 10 | |
| 473 | −11 | 9 | 15 | −4 | |
| 474 | 0 | 0 | 0 | 0 | |
| 475 | 0 | 0 | 9 | 22 | |
| 476 | 0 | 0 | 0 | 0 | |
| 477 | 0 | 0 | 7 | 9 | |
| 478 | 17 | 8 | −13 | −12 | |
| 479 | 30 | 11 | 24 | 43 | |
| 480 | 38 | 27 | 27 | 39 | |
| 481 | 55 | 17 | 10 | 36 | |
| 482 | 0 | 15 | 6 | 2 | |
| 483 | 31 | 43 | 5 | 11 | |

TABLE 6-1-continued

Four-point Pseudoneutralization screen of monoclonal antibodies
% Neutralization

| Antibody ID | 50 µg/mL | 10 µg/mL | 1 µg/mL | 0.1 µg/mL | 0.01 µg/mL |
|---|---|---|---|---|---|
| 484 | 10 | 28 | 8 | 8 | |
| 485 | 30 | 16 | 25 | 13 | |
| 486 | 13 | 20 | −13 | −5 | |
| 487 | 24 | 9 | 15 | 0 | |
| 488 | 74 | 19 | 39 | 25 | |
| 489 | −5 | 15 | 12 | 32 | |
| 491 | 11 | −4 | 34 | 18 | |
| 491 | 54 | 26 | 4 | 0 | |
| 492 | 36 | 21 | 0 | 0 | |
| 493 | 0 | 3 | −2 | −7 | |
| 494 | 13 | 19 | 23 | 10 | |
| 495 | 17 | 14 | 8 | 6 | |
| 496 | 38 | 26 | 6 | 0 | |
| 497 | 15 | 0 | 15 | 26 | |
| 498 | 34 | 20 | 21 | 4 | |
| 499 | −5 | 2 | −1 | 5 | |
| 500 | −29 | −45 | −17 | −4 | |
| 501 | 23 | 27 | 17 | 13 | |
| 503 | −4 | 0 | 14 | 9 | |
| 504 | 47 | 4 | 0 | 0 | |
| 505 | 11 | 8 | 0 | 0 | |
| 506 | 38 | 21 | −1 | −15 | |
| 507 | 12 | 0 | 21 | 16 | |
| 508 | −8 | −6 | −14 | 3 | |
| 509 | 59 | 23 | 36 | 23 | |
| 510 | 20 | 15 | 19 | 63 | |
| 511 | 16 | 11 | 4 | 8 | |
| 512 | 24 | 25 | 23 | 15 | |
| 513 | 12 | 10 | 7 | −6 | |
| 514 | 46 | 38 | 1 | 4 | |
| 515 | 5 | −11 | 43 | 22 | |
| 516 | 44 | 45 | 40 | 24 | |
| 517 | 0 | 0 | 0 | 0 | |
| 518 | −1 | −12 | −6 | 7 | |
| 519 | 5 | 9 | 9 | 14 | |
| 520 | −1 | 2 | −7 | 1 | |
| 521 | 15 | 16 | 4 | 11 | |
| 522 | 27 | 38 | 35 | 57 | |
| 523 | 31 | 37 | 42 | 0 | |
| 524 | 13 | 18 | 29 | 25 | |
| 525 | 8 | 24 | 20 | 33 | |
| 526 | 6 | 0 | 7 | 22 | |
| 527 | 13 | 14 | 19 | 0 | |
| 528 | −3 | −17 | −30 | −27 | |
| 529 | 8 | 7 | 4 | −8 | |
| 530 | −7 | −11 | −30 | −11 | |
| 531 | 14 | 0 | 27 | 7 | |
| 533 | 3 | 0 | 0 | 0 | |
| 534 | 13 | 17 | 3 | 8 | |
| 535 | 30 | 21 | −1 | 12 | |
| 536 | 39 | 0 | 29 | 3 | |
| 537 | 0 | 32 | 21 | 11 | |
| 538 | 33 | 9 | 31 | 4 | |
| 539 | | 31 | 20 | 10 | 13 |
| 540 | | 15 | 18 | 22 | 12 |
| 541 | 21 | 0 | 0 | 0 | |
| 542 | 6 | 24 | 0 | 0 | |
| 543 | 63 | 13 | 18 | 18 | |
| 544 | 15 | 0 | 0 | 0 | |
| 545 | 24 | 0 | 0 | 0 | |
| 546 | 50 | 25 | 0 | 0 | |
| 547 | 0 | 0 | 10 | 17 | |
| 548 | 25 | 9 | 0 | 0 | |
| 549 | | 84 | 55 | 25 | 27 |
| 550 | 38 | 1 | 0 | 0 | |
| 551 | 57 | 0 | 0 | 15 | |
| 552 | | 41 | 6 | 19 | 28 |
| 553 | | 26 | 28 | 8 | 6 |
| 554 | | −3 | −1 | 4 | 10 |
| 555 | | 88 | 47 | −5 | 7 |
| 556 | 0 | 0 | 0 | 7 | |
| 557 | | 4 | 13 | −2 | 1 |
| 558 | | 9 | −10 | 3 | 7 |
| 559 | | 9 | 5 | 45 | 27 |
| 559 | 34 | 17 | 42 | 26 | |
| 560 | 0 | 0 | 18 | 8 | |
| 561 | | −7 | 12 | −7 | −11 |
| 562 | | 18 | 8 | 6 | −19 |
| 563 | 18 | 11 | 5 | 0 | |
| 564 | 13 | 0 | 0 | 0 | |
| 565 | | 16 | 20 | 24 | 24 |
| 566 | 11 | 0 | 0 | 4 | |
| 567 | | 5 | 25 | 18 | 15 |
| 568 | | −4 | 6 | 5 | −2 |
| 569 | 15 | 15 | 5 | 0 | |
| 570 | | −2 | −10 | −5 | −17 |
| 571 | 36 | 3 | 33 | 35 | |
| 573 | | −11 | −7 | −15 | −10 |
| 574 | | −21 | 4 | 3 | 15 |
| 575 | | 13 | −1 | −2 | 2 |
| 576 | 3 | 17 | 17 | 0 | |
| 577 | | 9 | 2 | 9 | 9 |
| 578 | | 0 | 0 | 0 | |
| 579 | | 14 | 4 | 18 | 1 |
| 580 | 0 | 0 | 0 | 0 | |
| 581 | 13 | 20 | 25 | 0 | |
| 582 | 11 | 0 | 0 | 0 | |
| 583 | 0 | 0 | 21 | 19 | |
| 584 | | 9 | 30 | 25 | 26 |
| 585 | | 4 | −5 | 42 | 17 |
| 586 | 0 | 0 | 0 | 0 | |
| 587 | 1 | −9 | 3 | 18 | |
| 588 | 0 | 0 | 24 | 52 | |

TABLE 6-2

| Positive Control | Concentration (µg/mL) | % Neutralization |
|---|---|---|
| S652-118 | 50.0 | 65.94712289 |
| | 12.5 | 56.6591417 |
| | 3.125 | 35.52770257 |
| | 0.78125 | 14.37639388 |
| | 0.1953125 | −3.015215894 |
| | 0.048828125 | −11.2447797 |
| | 0.012207031 | −4.806124096 |

TABLE 6-3

| Positive Control | Dilution | % Neutralization |
|---|---|---|
| Mouse serum | 50 | 91.76866015 |
| | 200 | 67.11624723 |
| | 800 | 11.53270188 |
| | 3200 | −7.777682412 |
| | 12800 | −9.670886593 |
| | 51200 | −6.058915489 |
| | 204800 | 7.678774689 |

TABLE 6-4

IC$_{50}$ and IC$_{80}$ values for select anti-coronavirus antibodies

| Antibody ID | IC$_{50}$ (µg/mL) | IC$_{80}$ (µg/mL) | IC$_{90}$ (µg/mL) |
|---|---|---|---|
| 292 | >50 | >50 | |
| 309 | >50 | >50 | |
| 364 | >50 | >50 | |
| 373 | >50 | >50 | |
| 388 | >50 | >50 | |
| 408 | >50 | >50 | |

TABLE 6-4-continued $IC_{50}$ and $IC_{80}$ values for select anti-coronavirus antibodies

| | | |
|---|---|---|
| 414 | >50 | >50 |
| 417 | >50 | >50 |
| 419 | >50 | >50 |
| 442 | >50 | >50 |
| 445 | >50 | >50 |
| 447 | >50 | >50 |
| 462 | >50 | >50 |
| 479 | >50 | >50 |
| 481 | 17.16 | >50 |
| 483 | >50 | >50 |
| 488 | 3.52 | >50 |
| 494 | >50 | >50 |
| 506 | >50 | >50 |
| 539 | >50 | >50 |
| 540 | >50 | >50 |
| 549 | >50 | >50 |
| 552 | >50 | >50 |
| 553 | >50 | >50 |
| 555 | 0.38 | 1.40 |
| 562 | >50 | >50 |

| Controls | $IC_{50}$ (μg/mL) | $IC_{80}$ (μg/mL) | $IC_{90}$ (μg/mL) |
|---|---|---|---|
| S652-118 | 31.01 | >50 | n/a |
| Mouse serum | 78 | 58 | 51 |

Additional pseudovirus neutralization assays were carried out for select anti-coronavirus antibodies. SARS-CoV-2 Spike pseudotyped lentiviruses that harbor a luciferase reporter gene were produced by co-transfection of 293T cells with plasmids encoding the lentiviral packaging and luciferase reporter, a human transmembrane protease serine 2 (TMPRSS2), and SARS-CoV-2 S (Wuhan-1, Genbank #: MN908947.3) genes. Forty-eight hours after transfection, supernatants were harvested, filtered and frozen. For neutralization assay serial dilutions (2 dilutions at 10 and 1 μg/ml for the initial screen assay or 8 dilutions for the full curve at 10-0.0006 μg/ml) of monoclonal antibodies were mixed with titrated pseudovirus, incubated for 45 minutes at 37° C. and added to pre-seeded 293T-ACE2 cells in triplicate in 96-well white/black Isoplates (Perkin Elmer). Following 2 hours of incubation, wells were replenished with 150 μL of fresh medium. Cells were lysed 72 hours later and luciferase activity (relative light unit, RLU) was measured. Percent neutralization and neutralization $IC_{50}$ values were calculated using GraphPad Prism 8.0.2. Results are shown in Table 6-5.

TABLE 6-5

$IC_{50}$ values for select anti-coronavirus antibodies

| Antibody ID | $IC_{50}$ Wuhan-1 (μg/mL) |
|---|---|
| 555 | 0.009 |
| 851 | 2.262 |
| 896 | 0.156 |
| 923 | 0.093 |
| 936 | 0.051 |
| 970 | 0.087 |
| 1015 | 0.011 |
| 1036 | 0.039 |
| 1037 | 0.025 |
| 1075 | 0.039 |
| 1135 | 0.050 |
| 1139 | 0.018 |
| 1149 | 0.016 |
| 1404 | 0.006 |
| 1444 | 0.017 |
| 1538 | 0.114 |

Yet more pseudovirus neutralization assays were carried out for select anti-coronavirus antibodies. Serial dilution of purified antibodies (ten dilutions in a 3-fold step-wise manner) were mixed and incubated with SARS-CoV-2 WT and/or SARS-CoV-2 D614G *renilla* luciferase reporter viral particles (RVPs, Integral Molecular) in complete media (DMEM/F12, 10% FBS, 10 mM HEPES) for an hour at 37° C. before adding freshly trypsinized 293T-hsACE cells (Integral Molecular) to the culture. Following 72 hours of incubation the supernatant was carefully aspirated from each well and bioluminescence was measured using luciferase assay system (Promega) through a high throughput plate reader based assay. Controls were as follows: cell only, cell and virus only, and cell and virus with internal benchmark antibodies (positive control) and or irrelevant antibody (negative control). The relative luminescence units were first normalized based on cells only and no antibody controls and the data were subsequently plotted against the drug concentration. For each antibody tested, the concentration able to inhibit 50% of infection ($IC_{50}$) was calculated by using a nonlinear regression to fit the data point using GraphPad Prism 8 (GraphPad Software, Inc.). All samples were run in triplicates and mean and standard deviation calculated accordantly. The results are shown in Table 6-6.

TABLE 6-6

$IC_{50}$ values for select anti-coronavirus antibodies

| Antibody ID | $IC_{50}$ WT (μg/mL) | $IC_{80}$ D614G (μg/mL) |
|---|---|---|
| 555 | 0.0317 | 0.0255 |
| 894 | — | 2.02 |
| 923 | 0.1547 | — |
| 970 | 0.6582 | — |
| 1037 | 0.0212 | 0.0055 |
| 1075 | >10 | 0.4576 |
| 1404 | 0.0084 | 0.003 |
| 1444 | 0.1145 | |
| 1495 | >10 | 0.4884 |
| 1538 | >10 | >10 |

Example 7

Epitope Mapping of Anti-SARS-CoV-2 Antibody 555 and Other Anti-SARS-CoV-2 Antibodies by Hydrogen Deuterium Exchange Mass Spectrometry (HDX-MS)

Hydrogen deuterium exchange with mass spectrometry (HDX-MS) was performed in order to determine where the exemplified antibody (mAb 555) binds the SARS-CoV-2 Spike protein. Peptide identification for SARS-CoV-2 Spike was performed on a Waters SYNAPT™ G2Si (Waters Corporation) instrument using 5 μg of SARS-CoV-2 Spike at zero exchange (0.1×PBS in $H_2O$) using nepenthesin II (Nep II) for digestion. The mass spectrometer was set in HDMSe (Mobility ESI+ mode); in a mass acquisition range of m/z 255.00-1950.00; with a scan time of 0.4 s. Data was processed using PLGS 2.3.2 (Waters Corporation). For the exchange experiments, the complex of human SARS COV-2 Spike with mAb 555 was prepared at the molar ratio of 1:1.2 in 10 mM sodium phosphate buffer, pH 7.4 containing 150 mM NaCl (1×PBS buffer). The experiment was initiated by adding 25 uL of D20 buffer containing 0.1×PBS to 2.5 ul of Spike (1 mg/mL) or Spike-mAb 555 complex at 15° C. for various amounts of time (0s, 10s, 30s, 2 min, 10 min and 120 min) using a custom Tecan sample preparation system (Espada et al., *J. Am. Soc. Mass Spectrom.*, 2019, 30:2580-2583). The reaction was quenched using equal volume of was 0.32M TCEP, 3 M guanidine HCl, 0.1M phosphate pH 2.5 for two minutes at 4° C. and immediately frozen at −70° C. The sample injection system is comprised of a UR3 robot, a LEAP PAL3 HDX autosampler, and a HPLC system interfaced with a Waters SYNAPT® G2-Si (Waters Corporation) (modified from Espada et al.). The LC mobile phases consisted of water (A) and acetonitrile (B), each containing 0.2% formic acid. Each sample was thawed using 50 µL of 0.32M TCEP, 1.5 M guanidine HCl, 0.1M phosphate pH 2.5, for 1 min and injected on to a Nep II column for digestion at 4° C. with mobile phase A at the flow rate of 250 µL/min for 2.5 minutes. The resulting peptides were trapped on a Waters BEH VANGUARD™ Pre-column at 4° C., and chromatographically separated using a Waters ACQUITY UPLC™ BEH C18 analytical column at 4° C. with a flow rate of 200 µL/min and a gradient of 3%-85% mobile phase B over 7 minutes, and directed into mass spectrometer for mass analysis. The SYNAPT® G2-Si was calibrated with Glu-fibrinopeptide prior to use. Mass spectra were acquired over the m/z range of 255 to 1950 in HDMS mode, with the lock mass m/z of 556.2771 (Leucine Enkephalin). The relative deuterium incorporation for each peptide was determined by processing the MS data for deuterated samples along with the undeuterated control using the identified peptide list in DYNAMX™ 3.0 (Waters Corporation). The free and bound states of SARS-CoV-2 Spike were compared for deuterium incorporation differences.

The results are shown in Table 7.1. Sequence coverage for the SARS-CoV-2 Spike was 63.5%. Decrease in deuterium uptake between SARS-CoV-2 Spike plus mAb 555 complex vs. SARS-CoV-2 Spike alone was observed between residues 459-495 (SNLKPERISTEIYQAGSTPCNGVEGFN-CYFPLQSY; SEQ ID NO: 5380) and residues 434-444 (IAWNSNNLDSK; SEQ ID NO: 5379), pointing to the probable epitope region. These data suggest mAb 555 has an epitope comprising one or more residues within amino acids 434-444 and 459-495 of the SARS-CoV-2 Spike protein. The epitope region of mAb 555 correlate to the ACE2 binding site in SARS-CoV-2 Spike RBD region (Yan et al., 2020, Science. 367(6485):1444-1448.)

TABLE 7.1

Peptides at which decreased exchange was observed in SARS-CoV-2 Spike plus mAb 555 complex as compared to SARS-CoV-2 Spike alone (overlapping peptides observed).

| Residues | Peptide sequence | SEQ ID NO |
|---|---|---|
| 459-473 | SNLKPFERDISTEIY | 5368 |
| 467-473 | DISTEIY | 5369 |
| 468-473 | ISTEIY | 5370 |
| 472-486 | IYQAGSTPCNGVEGF | 5371 |
| 472-488 | IYQAGSTPCNGVEGFNC | 5372 |
| 474-486 | QAGSTPCNGVEGF | 5373 |
| 474-488 | QAGSTPCNGVEGFNC | 5374 |
| 487-495 | NCYFPLQSY | 5375 |
| 489-495 | YFPLQSY | 5376 |
| 434-439 | IAWNSN | 5377 |
| 434-441 | IAWNSNNL | 5378 |
| 434-444 | IAWNSNNLDSK | 5379 |

HDX-MS were also performed for additional anti-SARS-CoV-2 antibodies. The results are summarized in Table 7.2.

TABLE 7.2

Summary of HDX-MS data for additional anti-SARS-CoV-2 antibodies. Sequence ranges of the SARS-CoV-2 Spike protein exhibiting protection are shown; the number of peptides for each sequence range is indicated in parentheses.

| MAb | Regions showing protection |
|---|---|
| | NTD Binders |
| 364 | 136-144 (2), 171-178 (3), 242-264 (3) |
| 373 | 136-144 (2), 171-179 (2), 242-264 (3) |
| 417 | 92-102 (4), 136-144 (2), 171-179(3) 242-264(3) |
| 419 | 136-144 (2), 242-265 (4) |
| 483 | 136-144 (2) 242-265 (4) |
| | RBD Binders |
| 292 | 472-495 (6) |
| 447 | 467-513 (9) |
| 462 | 467-489 (7), |
| 481 | 467-490 (6) -496-513(2) |
| 488 | 417-421 (2), 433-444 (2), 467-513 (14) |
| 506 | 433-455 (4), 496-513(2) |
| | Undetermined/other binders |
| 408 | 136-143 (2), 307-318 (2), 621-636 (3) |
| 479 | 980-1006 (5) 1179-1186 (1) |
| 540 | 960-1007 (10) |

Example 8

Epitope Mapping of Anti-SARS-CoV-2 Fabs by Negative-Stain Electron Microscopy (nsEM)

Anti-SARS-CoV-2 antibodies were produced by expression in Chinese hamster ovary (CHO) cells, and purified using standard antibody purification techniques. The Fab portions of the antibodies were generated by proteolytic digestion using papain, followed by removal of un-cleaved protein using standard chromatography techniques.

SARS-CoV-2 Spike ectodomain was diluted to 0.04 mg/mL in 2 mM Tris pH 8.0, 200 mM NaCl, 0.02% $NaN_3$ (dilution buffer) in the presence of 10-fold excess Fab, and incubated on ice for either 10 seconds (Fab 555), 2 minutes (Fab 447), 5 minutes (Fabs 309, 488, 562, 506, 442, 417, 462, 292, 540, 479, 553, 388), or 20 minutes (Fabs 447, 483, 419, 494). CF400-Cu grids (Electron Microscopy Sciences) were plasma cleaned for 30 seconds in a SOLARUS® 950 plasma cleaner (Gatan) with a 4:1 ratio of $O_2/H_2$. 4.8 μl of the protein sample was applied to the grid and allowed to incubate for 30 sec. The grid was then washed twice with dilution buffer stained with methylamine tungstate (NANO-W, Nanoprobes). Grids were then imaged using an FEI TALOS™ TEM (Thermo Scientific) and a Ceta 16M detector. Micrographs were collected manually using TIA v4.14 software at a magnification of ×92,000, corresponding to a pixel size of 1.63 Å/pixel. CTF estimation and particle picking were performed in cisTEM. 2D classification was performed in either cisTEM (Grant, et al., 2018. "CisTEM, User-Friendly Software for Single-Particle Image Processing." Edited by Edward H Egelman. *ELife* 7 (March): e35383) or CRYOSPARC™ (Punjani, *Nature Methods* 14 (3): 290-96, 2017), and ab initio reconstruction and refinement for 3D maps were performed in CRYOSPARC™.

Binding kinetics were determined based on biolayer interferometry. 50 nM 2×-Strep-tagged SARS-CoV-2 ectodomain in BLI buffer (10 mM HEPES pH 7.5, 150 mM NaCl, 3 mM EDTA, 0.05% Tween 20 and 1 mg/mL BSA) was immobilized onto a streptavidin biosensor (ForteBio) for 600s using an Octet RED96e (FortéBio). The biosensor was then dipped into 100 nM Fab (diluted in BLI buffer), and the association signal was measured for 600 sec. Following this, the biosensor was dipped into BLI buffer to measure the dissociation signal for 600 sec. Data were reference-subtracted and fit to a 1:1 binding model using Octet Data Analysis Software v11.1 (FortéBio).

The nsEM results and binding kinetics for Fabs 555, 447, 494, 483, 419 and 388 are shown in FIGS. 2-8. The other Fabs were not seen by nsEM. The nsEM imaging and three dimensional reconstruction of the complex confirms that Fab 555 binds the RBD domain of the SARS-CoV-2 Spike protein in an orientation that would directly interfere with the known ACE2-Spike protein interaction (Yan et al., "Structural basis for the recognition of SARS-CoV-2 by full-length human ACE2." *Science*. 367(6485): 1444-1448 (2020)).

Example 9

Live Virus Neutralization Assay of Anti-SARS-CoV-2 Antibodies

The efficacy of some anti-SARS-CoV-2 antibodies (mAbs 555, 419, 481, 488, 373) were measured by detecting the neutralization of infectious SARS-CoV-2 virus in a dose-response mode using cultured Vero 76/E6 cells. These cells are known to be highly susceptible to infection by SARS-CoV-2. The assays were developed and performed at three independent laboratories by modifying previously published methods for use with SAR-CoV-2.

Assays at Lab 1 and Lab 2 were conducted using natural virus produced by infecting cultured Vero E6 cells with the SARS-CoV-2 clinical isolate USA/WA/1/2020 (BEI resources number NR52281) and incubating at 37° C. until cytopathology was evident (typically 48-72 hours). Expansion was limited to only 1-2 passages in cell culture to retain integrity of the original viral sequence. The virus stock was quantified by standard plaque assay, and aliquots were stored at −80° C. A freshly-thawed aliquot is used for each neutralization experiment.

Assays at Lab 2 were also conducted using the Italy-INMI1 isolate of SARS-CoV-2 (European Virus Archive—Global, ref #008V-03893), similarly grown in Vero E6 cells, titered by plaque assay and stored frozen.

Assays at Lab 3 were performed using a modified version of the USA/WA/1/2020 isolate in which a non-essential gene (ORF7) was replaced by the NANOLUC® luciferase reporter gene (Promega). This technology was previously described for SARS-CoV and MERS-CoV (Sheahan, et al., *Sci. Transl. Med.* 2017; 9 eaa13653).

Briefly, 20-140 plaque-forming units of virus were pre-incubated with serial dilutions of anti-SARS-CoV-2 antibodies (8-10 points per curve) for 1 hour at 37° C., inoculated onto monolayers of Vero E6 cells, and incubated at 37° C. to allow the non-neutralized virus to replicate.

The inhibition of replication resulting from virus neutralization by mAb555 was detected by the following methods: (1) Decreased production of viral nucleocapsid protein (NP) as detected using murine monoclonal antibody to SARS-CoV-2 NP with standard immunostaining techniques (Lab 1 method); (2) Protection against virus-induced cell death as detected by standard plaque assay (Lab 2 method); or (3) Decreased signal from the inserted luciferase reporter gene (Lab 3 method).

Each sample was tested using 2-3 replicates per antibody dilution. Either mouse or human convalescent serum was used as a positive control. Percent neutralization was calculated relative to the signals produced by an IgG isotype antibody control and a no-virus control, and the data were plotted using nonlinear regression with a four-parameter fit analysis (GraphPad Prism v8.0.0). Overall estimates for $IC_{50}$ and $IC_{99}$ were made using a meta-analysis with all data from the 4 laboratories using a random effects model (Berkey, et al., *Stat Med.* 1995; 14(4):395-411) and the R package metafor (Viechtbauer, *J. Stat. Software* 2010; 36(3): 1-48).

The results of the neutralization assays for mAbs 555, 419, 481, 488, and 373 are presented in Table 9.1 and Table 9.2. Taken together, mAb 555 is shown to be a potent inhibitor of virus infectivity, with an estimated $IC_{50}$=0.03 µg/mL (95% CI: 0.01 µg/mL, 0.12 µg/mL) and $IC_{99}$=0.43 µg/mL (95% CI: 0.13 µg/mL, 1.43 µg/mL) for the USA/WA/1/2020 clinical isolate, and an estimated $IC_{50}$=0.05 µg/mL (95% CI: 0.04 µg/mL, 0.05 µg/mL) and $IC_{99}$=1.42 µg/mL (95% CI: 0.94 µg/mL, 2.13 µg/mL) for the Italy-INMI1 clinical isolate. $IC_{99}$ was calculated for mAb 555 only.

TABLE 9.1

Results of Neutralization Assays of USA/WA/1/2020 isolate by mAbs 555, 419, 481, 488, 373

| Study Location | Detection Method | IC50, pg/mL (95% CI) |
| --- | --- | --- |
| mAb 555 | | |
| Lab 1 | Detection of viral nucleoprotein | 0.16 (0.15, 0.17) |
| Lab 2 | Plaque reduction | 0.02 (0.01, 0.02) |
| Lab 3- Run #1 | Luciferase reporter | 0.04 (0.01, 0.23) |
| Lab 3- Run #2 | Luciferase reporter | 0.01 (0.00, 0.03) |
| mAb 555 Overall | | 0.03 (0.01, 0.12) |
| mAb 419 | | |
| Lab 1 | Detection of viral nucleoprotein | 0.65 (0.56, 0.75) |
| Lab 2 | Plaque reduction | 1.54 (0.30, 7.80) |
| Lab 3 | Luciferase reporter | 0.61 (0.40, 0.95) |
| mAb 419 Overall | | 0.65 (0.57, 0.74) |
| mAb 481 | | |
| Lab 1 | Detection of viral nucleoprotein | 3.18 (2.28, 4.44) |
| Lab 2 | Plaque reduction | N/A |
| Lab 3 | Luciferase reporter | 6.03 (4.75, 7.66) |
| mAb 481 Overall | | 4.43 (2.37, 8.29) |
| mAb 488 | | |
| Lab 1 | Detection of viral nucleoprotein | 1.69 (0.34, 8.52) |
| Lab 2 | Plaque reduction | 0.86 (0.47, 1.59) |
| Lab 3 | Luciferase reporter | 0.94 (0.73, 1.22) |
| mAb 488 Overall | | 0.94 (0.74, 1.19) |
| mAb 373 | | |
| Lab 1 | Detection of viral nucleoprotein | 17.4 (4.8, 62.9) |
| Lab 2 | Plaque reduction | N/A |
| Lab 3 | Luciferase reporter | 12.8 (3.2, 50.9) |
| mAb 373 Overall | | 15.1 (5.9, 38.6) |

TABLE 9.2

Results of Neutralization Assays of Italy-INMI1 isolate by mAb 555

| Study Location | Detection Method | IC50, ug/mL (95% CI) |
| --- | --- | --- |
| Lab 2 | Plaque reduction | 0.05 (0.04, 0.05) |

TABLE 9.3

Results of Neutralization Assays of other anti-SARS-CoV-2 mAbs

| MAb | Lab 1 live virus $IC_{50}$ | Lab3 live virus $IC_{50}$ | Lab2 PRNT $IC_{50}$ (WA isolate) | Lab2 PRNT $IC_{50}$ (Italy isolate) |
|---|---|---|---|---|
| 292 | 1.25 µg/mL | 9.9 µg/mL | — | |
| 294 | ND | ND | | |
| 309 | >20 µg/mL | >100 µg/mL | | |
| 320 | ND | ND | | |
| 364 | 10 µg/mL | >100 µg/mL | | |
| 388 | >>40 µg/mL | >100 µg/mL | | |
| 408 | 1.25 µg/mL | 1.2 µg/mL | | |
| 412 | ND | ND | | |
| 414 | >20 µg/mL | >100 µg/mL | | |
| 417 | >40 µg/mL | >100 µg/mL | >100 µg/mL | |
| 442 | >40 µg/mL | >100 µg/mL | >100 µg/mL | |
| 445 | ND | ND | | |
| 447 | 1.25 µg/mL | 1.8 µg/mL | | 11.2 µg/mL |
| 462 | 10 µg/mL | >100 µg/mL | | |
| 479 | >40 µg/mL | >100 µg/mL | | |
| 483 | 0.63 µg/mL | 27 µg/mL | >100 µg/mL | |
| 494 | 2.5 µg/mL | 23.6 µg/mL | | |
| 506 | 1.25 µg/mL | 2 µg/mL | | |
| 540 | >40 µg/mL | >100 µg/mL | | |
| 549 | ND | ND | | |
| 552 | ND | ND | | |
| 553 | 20 µg/mL | >100 µg/mL | | |
| 562 | >40 µg/mL | >100 µg/mL | | |

Example 10

Binding of Anti-SARS-CoV-2 Antibody 555 to SARS-CoV-2 Spike Protein with Known Mutations To identify mutations arising in the viral population that might impair binding and neutralization by mAb 555, an in-house viral surveillance bioinformatics workflow was established. Sequences of SARS-CoV-2 were downloaded from the GISAID database (Elbe, S., and Buckland-Merrett, G., 2017, *Global Challenges*, 1: 33-46) every 4 days as full-length DNA sequences, which were then processed via custom MATLAB® (MathWorks) scripts to align the Spike sequences and extract mutational information with respect to a reference Spike protein sequence from the strain hCoV-19/Wuhan/IVDC-HB-01/2019 (EPI_ISL_402119). Optional patient metadata generated by bioinformatic tools Nextstrain (Hadfield et al., 2018, *Bioinformatics;* 34(23), 4121-4123) were used to supplement the sequence data. Sequences were discarded if they contained >5% ambiguous bases of the Spike protein, had <80% DNA identity to the reference Spike, or contained multiple inserted or deleted bases, all of which indicate sequencing errors rather than antigenic drift. The MATLAB® scripts parsed the filtered data to summarize the frequency of mutation, the codons of the mutated residues, potential mutations, duration in circulation, and locations of strain isolation. For a Spike mutation to be considered for in-depth binding characterization with mAb 555, the following threshold was used: mutations must appear >5 times, be isolated from >1 locations, be circulating for >13 days, and reside within the receptor binding domain (RBD, residues 329-520).

Mutations that have arisen in the receptor binding domain of SARS-CoV-2 variants are listed in Table 10.1, along with the number of occurrences. The RBD mutations are rare and collectively appear in 0.5% of the deposited sequences.

Binding experiments were carried out with full-length SARS-CoV-2 Spike protein. Suspension CHO cells were transiently transfected with the plasmid using electroporation. Full length Spike protein expression (using the original Wuhan reference sequence) was confirmed by testing with benchmark antibodies discovered against SARS-CoV that target different stalk and head domains, using flow cytometry. Furthermore, western blot was performed with a whole cell and plasma membrane isolate to confirm full length protein expression on the cell surface. mAb 555 was confirmed to bind the screening target (SARS-CoV-2 full length Spike) using high throughput flow cytometry. CHO cells were transiently transfected to express the full length Spike protein of either the reference sequence or mutants of SARS-CoV-2 Spike protein on the cell surface. mAb 555 was incubated with the readout cells, and an untransfected control CHO line either at 50 nM antibody concentration for 30 minutes at 4° C. CHO cells were washed, and binding was detected by using a fluorescently labeled anti-human secondary antibody. Fluorescence was measured using high throughput plate-based flow cytometry. Benchmark antibodies identified to SARS were used as positive control due to similarity in Spike sequences between SARS and SARS-CoV-2; human IgG isotype and an irrelevant antibody were used as negative controls. Median fluorescence intensity of each antibody was normalized over the median fluorescence intensity of the human isotype control for respective antigens. Antibody values greater than 5-fold over isotype were considered as binders. The cut-off value was determined based on the binding to the negative controls.

mAb 555 was capable of binding to three of the mutations tested (Table 10.2). Of the mutations that have been observed, only two mutated residues (G476S and V483A) reside within the epitope for mAb 555. The first mutation of these to arise, V483A, was incorporated into an isolated receptor binding domain, and the binding affinity of this reagent to mAb 555 was tested as described above. In this experiment, mAb555 bound both the reference receptor binding domain and the mutated domain containing the V483A mutation with similar affinities (Table 10.3).

TABLE 10.1

Mutation frequencies within the receptor binding domain of the SARS-CoV-2 Spike protein (residues 329-520) that have been observed within the detection threshold, based on the GISAID database as of 28 Apr. 2020.

| Mutation | Number of occurrences (from a total of >10000 sequence entries) |
|---|---|
| V367F | 15 |
| Q414E | 7 |
| G476S | 9 |
| V483A | 24 |
| A520S | 6 |

TABLE 10.2

Binding of mAb 555 to mutant forms of the full length SARS-CoV-2 Spike protein by high-throughput flow cytometry

| Protein | Number of measurements | Range of determined fluorescence signal, relative to isotype control |
|---|---|---|
| Negative control (untransfected cells) | 2 | 0.64-0.9 fold over control |
| Reference Spike protein | 3 | 13.8-28.7 fold over control |
| V367F | 3 | 18.4-42.6 fold over control |
| G476S | 2 | 36.7-46.9 fold over control |
| V483A | 4 | 19.5-62.7 fold over control |

TABLE 10.3

Effect of the V483A mutation on the binding affinity of mAb 555, measured by surface plasmon resonance (CARTERRA ® LSA)

| Receptor binding domain | Binding affinity (KD) |
|---|---|
| Reference Spike protein | $1.96 \times 10^{-9}$ M |
| V483A | $4.41 \times 10^{-9}$ M |

Example 11

Nucleic Acid Sequence of Encoding Genes and Translated Amino Acid Sequence of mAb 555

Non-coding sequences are italicized. DNA coding sequence for the mskappa ss is underlined with a solid line. DNA coding sequence for the variable domain is in bold font. DNA coding sequence for the human kappa constant domain is in normal font. DNA coding sequence for the translational stop codons are italicized and underlined with a solid line.

| | DNA Sequence for encoding the mAb 555 HC |
|---|---|
| 1 | *AAGCTTGCTC GAGCCACC*<u>AT GGAGACAGAC ACACTCCTGC TATGGGTACT GCTGCTCTGG</u> |
| 61 | <u>GTTCCAGGAT CCACTGGACA</u> GGTGCAGCTG GTGCAGTCTG GGGCTGAGGT GAAGAAGCCT |
| 121 | GGGTCCTCGG TGAAGGTCTC CTGCAAGGCT TCTGGAGGCA CCTTCAGCAA CTATGCTATC |
| 181 | AGCTGGGTGC GACAGGCCCC TGGACAAGGG CTTGAGTGGA TGGGAAGGAT CATCCCTATC |
| 241 | CTTGGTATAG CAAACTACGC ACAGAAGTTC CAGGGCAGAG TCACGATTAC CGCGGACAAA |
| 301 | TCCACGAGCA CAGCCTACAT GGAGCTGAGC AGCCTGAGAT CTGAGGACAC GGCCGTGTAT |
| 361 | TACTGTGCGA GAGGTTACTA CGAAGCGAGG CATTACTACT ACTACTACGC TATGGACGTC |
| 421 | TGGGGCCAAG GGACCGCGGT CACCGTCTCC TCAGCCTCCA CCAAGGGCCC ATCGGTCTTC |
| 481 | CCCCTGGCAC CCTCCTCCAA GAGCACCTCT GGGGGCACAG CGGCCCTGGG CTGCCTGGTC |
| 541 | AAGGACTACT TCCCCGAACC GGTGACGGTG TCGTGGAACT CAGGCGCACT GACCAGCGGC |
| 601 | GTGCACACCT TCCCGGCTGT CCTACAGTCC TCAGGACTCT ACTCCCTCAG CAGCGTGGTG |
| 661 | ACCGTGCCCT CCAGCAGCTT GGGCACCCAG ACCTACATCT GCAACGTGAA TCACAAGCCC |
| 721 | AGCAACACCA AGGTGGACAA GAGAGTTGAG CCCAAATCTT GTGACAAAAC TCACACATGC |
| 781 | CCACCGTGCC CAGCACCTGA ACTCCTGGGG GGACCGTCAG TCTTCCTCTT CCCCCCAAAA |
| 841 | CCCAAGGACA CCCTCATGAT CTCCCGGACC CCTGAGGTCA CATGCGTGGT GGTGGACGTG |
| 901 | AGCCACGAAG ACCCTGAGGT CAAGTTCAAC TGGTATGTGG ACGGCGTGGA GGTGCATAAT |
| 961 | GCCAAGACAA AGCCGCGGGA GGAGCAGTAC AACAGCACGT ACCGTGTGGT CAGCGTCCTC |
| 1021 | ACCGTCCTGC ACCAAGACTG GCTGAATGGC AAGGAGTACA AGTGCAAGGT CTCCAACAAA |
| 1081 | GCCCTCCCAG CCCCCATCGA GAAAACCATC TCCAAAGCCA AAGGGCAGCC CCGAGAACCA |
| 1141 | CAGGTGTACA CCCTGCCCCC ATCCCGGGAG GAGATGACCA AGAACCAAGT CAGCCTGACC |
| 1201 | TGCCTGGTCA AAGGCTTCTA TCCCAGCGAC ATCGCCGTGG AGTGGGAGAG CAATGGGCAG |
| 1261 | CCGGAGAACA ACTACAAGAC CACGCCTCCC GTGCTGGACT CCGACGGCTC CTTCTTCCTC |
| 1321 | TATTCCAAGC TCACCGTGGA CAAGAGCAGG TGGCAGCAGG GGAACGTCTT CTCATGCTCC |
| 1381 | GTGATGCATG AGGCTCTGCA CAACCACTAC ACGCAGAAGA GCCTCTCCCT GTCTCCGGGC |
| 1441 | AAA<u>*TGA*</u>*TAGG TTTAAACCGA ATTC* (SEQ ID NO: 5381) |

Non-coding sequences are italicized. DNA coding for mskappa ss is underlined with a solid line. DNA coding for the variable domain of anti-SARS-CoV-2 HC is in bold font. DNA coding sequence for the human IgG1 constant domain is in normal font. DNA coding sequence for the translational stop codons are italicized and underlined with a solid line.

---

DNA Sequence for encoding ther mAb 555 LC

---

1 *AAGCTTGCTC GAGCCACC*<u>AT GGAGACAGAC ACACTCCTGC TATGGGTACT GCTGCTCTGG</u>

61 <u>GTTCCAGGAT CTACTGGC</u>GA CATCCAGATG ACCCAGTCTC CATCCTCCCT GTCTGCATCT

121 GTAGGAGACA GAGTCACCAT CACTTGCCGG GCAAGTCAGA GCATTAGCAG CTATTTAAGT

181 TGGTATCAGC AGAAACCAGG GAAAGCCCCT AAGCTCCTGA TCTATGCTGC ATCCAGTTTG

241 CAAAGTGGGG TCCCATCAAG GTTCAGTGGC AGTGGATCTG GGACAGATTT CACTCTCACC

301 ATCACCAGTC TGCAACCTGA AGATTTTGCA ACTTACTACT GTCAACAGAG TTACAGTACC

361 CCTCGCACGT TCGGCCAAGG GACCAAGGTG GAAATCAAAA GAACTGTGGC GGCGCCATCT

421 GTCTTCATCT TCCCGCCATC TGATGAGCAG TTGAAATCCG AACTGCCTC TGTTGTGTGC

481 CTGCTGAATA ACTTCTATCC CAGAGAGGCC AAAGTACAGT GGAAGGTGGA TAACGCCCTC

541 CAATCGGGTA ACTCCCAGGA GAGTGTCACA GAGCAGGACA GCAAGGACAG CACCTACAGC

601 CTCAGCAGCA CCCTGACGCT GAGCAAAGCA GACTACGAGA AACACAAAGT CTACGCCTGC

661 GAAGTCACCC ATCAGGGCCT GAGCTCGCCC GTCACAAAGA GCTTCAACAG GGGAGAGTGC

721 *<u>TAATAG</u>GTTT AAACCGAATT C* (SEQ ID NO: 5382)

---

Non-coding sequences are italicized. DNA coding sequence for the mskappa ss is underlined with a solid line. DNA coding sequence for the variable domain is in bold font. DNA coding sequence for the human kappa constant domain is in normal font. DNA coding sequence for the translational stop codons are italicized and underlined with a solid line.

---

Deduced Mature Amino Acid Sequence for mAb 555 HC (SEQ ID NO: 5363)

---

1   QVQLVQSGAE VKKPGSSVKV SC|KASGGTFS NYAIS|WVRQA PGQGLEWMG|IIPILGIANY

61  |AQKFQG|RVTI TADKSTSTAY MELSSLRSED TAVYYC|ARGY YEARHYYYYY AMDV|WGQGTA

121 VTVSSASTKG PSVFPLAPSS KSTSGGTAAL GCLVKDYFPE PVTVSWNSGA LTSGVHTFPA

181 VLQSSGLYSL SSVVTVPSSS LGTQTYICNV NHKPSNTKVD KRV<u>EPKSCDK THTCPPCPAP</u>

241 ELLGGPSVFL FPPKPKDTLM ISRTPEVTCV VVDVSHEDPE VKFNWYVDGV EVHNAKTKPR

301 EEQYNSTYRV VSVLTVLHQD WLNGKEYKCK VSNKALPAPI EKTISKAKGQ PREPQVYTLP

361 PSREEMTKNQ VSLTCLVKGF YPSDIAVEWE SNGQPENNYK TTPPVLDSDG SFFLYSKLTV

421 DKSRWQQGNV FSCSVMHEAL HNHYTQKSLS LSPGK

---

The variable domain is in bold font and the human IgG1 G1m3 constant chain is in normal font. The IgG1 hinge region is underlined. The CDR sequences are shown using borders.

Deduced Mature Amino Acid Sequence for mAb 555 LC (SEQ ID NO: 5364)

```
  1  DIQMTQSPSS LSASVGDRVT ITC RASQSIS SYLS WYQQKP GKAPKLLIY A ASSLQS GVPS

61  RFSGSGSGTD FTLTITSLQP EDFATYYC QQ SYSTPRT FGQ GTKVEIKRTV AAPSVFIFPP

121  SDEQLKSGTA SVVCLLNNFY PREAKVQWKV DNALQSGNSQ ESVTEQDSKD STYSLSSTLT

181  LSKADYEKHK VYACEVTHQG LSSPVTKSFN RGEC
```

The variable domain is in bold font and the human kappa constant domain is in normal font. CDR sequences are shown using borders.

TABLE 11-1 mAb 555-HC and LC CDR sequences

| | Sequence | SEQ ID NO |
|---|---|---|
| CDR-H1 | KASGGTFSNYAIS | 5383 |
| CDR-H2 | RIIPILGIANYAQKFQG | 5384 |
| CDR-H3 | ARGYYEARHYYYYYAMDV | 5385 |
| CDR-L1 | RASQSISSYLS | 5386 |
| CDR-L2 | YAASSLQS | 5387 |
| CDR-L3 | QQSYSTPRT | 5388 |

The CDR sequences of other exemplary antibodies are shown below in Table 11-2.

TABLE 11-2

| | | SEQ ID NO |
|---|---|---|
| Internal Designation No.: 258 | | |
| CDR-H1 | TVSGGSISSYYWS | 5389 |
| CDR-H2 | RIYTSGSTNYNPSLKS | 5390 |
| CDR-H3 | AAGYGSIDY | 5391 |
| CDR-L1 | RSSQSLLHSNGYNYLD | 5392 |
| CDR-L2 | YLGSNRAS | 5393 |
| CDR-L3 | MQALQTPRT | 5394 |
| Internal Designation No.: 291 | | |
| CDR-H1 | AASGFTFSSYAMH | 5395 |
| CDR-H2 | VISYDGSNKYYADSVKG | 5396 |
| CDR-H3 | ARASGGSYFGGMDV | 5397 |
| CDR-L1 | TGTSSDVGGYNYVS | 5398 |
| CDR-L2 | YEVSNRPS | 5399 |
| CDR-L3 | SSYTSSSTLYV | 5400 |
| Internal Designation No.: 292 | | |
| CDR-H1 | AASGFTVSSNYMS | 5401 |
| CDR-H2 | VIYSGGSTYYADSVKG | 5402 |
| CDR-H3 | ARDLQGGGGP | 5403 |
| CDR-L1 | RASQGIRNDLG | 5404 |
| CDR-L2 | YAASSLQS | 5405 |
| CDR-L3 | LQDYNYPRT | 5406 |
| Internal Designation No.: 308 | | |
| CDR-H1 | SVSGGSISSSSYHWG | 5407 |
| CDR-H2 | SIYYSGSTYYNPSLKS | 5408 |
| CDR-H3 | AGLRVVITFGGVIPKGGAFDI | 5409 |
| CDR-L1 | TGTSSDVGGYNYVS | 5410 |
| CDR-L2 | YDVSNRPS | 5411 |
| CDR-L3 | SSYTSSSTVV | 5412 |

TABLE 11-2-continued

| | | SEQ ID NO |
|---|---|---|
| Internal Designation No.: 309 | | |
| CDR-H1 | AASGFTFSSYAMH | 5413 |
| CDR-H2 | VISYDGSNKYYADSVKG | 5414 |
| CDR-H3 | ARPYSGSYQSYFDY | 5415 |
| CDR-L1 | RASQSVSSSYLA | 5416 |
| CDR-L2 | YGASSRAT | 5417 |
| CDR-L3 | QQYGSSPLT | 5418 |
| Internal Designation No.: 361 | | |
| CDR-H1 | TVSGGSISSGGYYWS | 5419 |
| CDR-H2 | YIYYSGSTYYNPSLKS | 5420 |
| CDR-H3 | ATTMVRGVIRLDHYGMDV | 5421 |
| CDR-L1 | TGTSSDVGGYNYVS | 5422 |
| CDR-L2 | YEVSNRPS | 5423 |
| CDR-L3 | SSYTSSSTLL | 5424 |
| Internal Designation No.: 364 | | |
| CDR-H1 | TASGFTFGDYAMS | 5425 |
| CDR-H2 | FIRSKAYGGTTEYAASVKG | 5426 |
| CDR-H3 | TRFGIDYDYIWGSYRYTTLFDY | 5427 |
| CDR-L1 | RASQSISSWLA | 5428 |
| CDR-L2 | YKASSLES | 5429 |
| CDR-L3 | QQYNSYSYT | 5430 |
| Internal Designation No.: 373 | | |
| CDR-H1 | TVSGGSISSYYWS | 5431 |
| CDR-H2 | YIYYSGSTNYNPSLKS | 5432 |
| CDR-H3 | ARGPDYYDFWSGYFYGMDV | 5433 |
| CDR-L1 | RASQSVSSSYLA | 5434 |
| CDR-L2 | YGASSRAT | 5435 |
| CDR-L3 | QQYGSSLT | 5436 |
| Internal Designation No.: 388 | | |
| CDR-H1 | AASGFTFNSYAIH | 5437 |
| CDR-H2 | VISYDGSNKYYADSVKG | 5438 |
| CDR-H3 | ARGRGGYRSYFDY | 5439 |
| CDR-L1 | RASQSVSSSYLA | 5440 |
| CDR-L2 | YGASSRAT | 5441 |
| CDR-L3 | QQYGSSPNT | 5442 |
| Internal Designation No.: 408 | | |
| CDR-H1 | AASGFTFSSYAMH | 5443 |
| CDR-H2 | VISYDGSNKYYADSVKG | 5444 |
| CDR-H3 | AKGADTPHYSGYDFLSVGYYYYGMDV | 5445 |
| CDR-L1 | RASQSISSYLN | 5446 |
| CDR-L2 | YAASSFQS | 5447 |
| CDR-L3 | QQSYSAPFT | 5448 |
| Internal Designation No.: 414 | | |
| CDR-H1 | KASGYTFTSYYMH | 5449 |
| CDR-H2 | IINPSGGSTSYAQKFQG | 5450 |
| CDR-H3 | ARDPPGRDFWSGYYFGAPDYYYYYGMDV | 5451 |
| CDR-L1 | RASQGISNYLA | 5452 |
| CDR-L2 | YAASSLQS | 5453 |
| CDR-L3 | QQYNSYPYT | 5454 |

TABLE 11-2-continued

|  |  | SEQ ID NO |
|---|---|---|
| Internal Designation No.: 417 | | |
| CDR-H1 | TVSGGSISSSSYYWG | 5455 |
| CDR-H2 | SIYYSGSTYYNPSLKS | 5456 |
| CDR-H3 | ARAPIMITFGGVTGHFDY | 5457 |
| CDR-L1 | RASQSVSSSYLA | 5458 |
| CDR-L2 | YGASSRAT | 5459 |
| CDR-L3 | QQYGSSPLT | 5460 |
| Internal Designation No.: 419 | | |
| CDR-H1 | KASGYTFTSYYMH | 5461 |
| CDR-H2 | IINPSGGSTSYAQKFQG | 5462 |
| CDR-H3 | ARDWTQSSGYDYYYGLDV | 5463 |
| CDR-L1 | SGDALPKQYAY | 5464 |
| CDR-L2 | YKDSERPS | 5465 |
| CDR-L3 | QSADSSGTYVV | 5466 |
| Internal Designation No.: 442 | | |
| CDR-H1 | AASGFTFSSYAMH | 5467 |
| CDR-H2 | VISYDGSNKYYADSVRG | 5468 |
| CDR-H3 | ARPKGGSYSDAFDI | 5469 |
| CDR-L1 | RASQSVSSSYLA | 5470 |
| CDR-L2 | YGASSRAT | 5471 |
| CDR-L3 | QQYGSSPQS | 5472 |
| Internal Designation No.: 445 | | |
| CDR-H1 | KASGYTFTSYYMH | 5473 |
| CDR-H2 | IINPSGGSTSYAQKFQG | 5474 |
| CDR-H3 | ARDPTEVGATSEYYYYGMDV | 5475 |
| CDR-L1 | SGDALPKQYAY | 5476 |
| CDR-L2 | YKDSERPS | 5477 |
| CDR-L3 | QSADSSGTYVV | 5478 |
| Internal Designation No.: 447 | | |
| CDR-H1 | AASGFTVSSNYMS | 5479 |
| CDR-H2 | VIYSGGSTYYADSVKG | 5480 |
| CDR-H3 | ARDKSSGSGP | 5481 |
| CDR-L1 | RASQGIRNDLG | 5482 |
| CDR-L2 | YAASSLQS | 5483 |
| CDR-L3 | LQDYNYPRT | 5484 |
| Internal Designation No.: 462 | | |
| CDR-H1 | AASGFTFSSYGMH | 5485 |
| CDR-H2 | VIWYDGNNKYYADSVKG | 5486 |
| CDR-H3 | AKDPTWFGELPSYYYYGMDV | 5487 |
| CDR-L1 | RASQSISSWLA | 5488 |
| CDR-L2 | YKASSLES | 5489 |
| CDR-L3 | QQYNSYPPIT | 5490 |
| Internal Designation No.: 479 | | |
| CDR-H1 | AASGFTFSSYSMN | 5491 |
| CDR-H2 | YISSSSTIYYADSVKG | 5492 |
| CDR-H3 | ARDLGARTPWDIVVVPAAMDY | 5493 |
| CDR-L1 | RASQSVSSSYLA | 5494 |
| CDR-L2 | YGASSRAT | 5495 |
| CDR-L3 | QQYGRSPNT | 5496 |
| Internal Designation No.: 481 | | |
| CDR-H1 | AASGFTVSSNYMS | 5497 |
| CDR-H2 | VIYSGGSTFYADSVKG | 5498 |
| CDR-H3 | AREVAGTYDY | 5499 |
| CDR-L1 | RASQGISSWLA | 5500 |
| CDR-L2 | YAASSLQS | 5501 |
| CDR-L3 | QQANSFPGGT | 5502 |
| Internal Designation No.: 483 | | |
| CDR-H1 | TVSGGSISSYYWS | 5503 |
| CDR-H2 | YIYYSGSTNYNPSLKS | 5504 |
| CDR-H3 | ARAPEEKSSEIGELVGWGWFDP | 5505 |

TABLE 11-2-continued

|  |  | SEQ ID NO |
|---|---|---|
| CDR-L1 | SGDKLGDKYAC | 5506 |
| CDR-L2 | YQDSKRPS | 5507 |
| CDR-L3 | QAWDSSTVV | 5508 |
| Internal Designation No.: 488 | | |
| CDR-H1 | AASGLTVSSNYMS | 5509 |
| CDR-H2 | VIYSGGSTYYADSVKG | 5510 |
| CDR-H3 | ARSPYGGNS | 5511 |
| CDR-L1 | QASQDISNYLN | 5512 |
| CDR-L2 | YDASNLET | 5513 |
| CDR-L3 | QQYDNLPIT | 5514 |
| Internal Designation No.: 489 | | |
| CDR-H1 | AASGFTFSSYAMH | 5515 |
| CDR-H2 | VISYDGSNKYYADSVKG | 5516 |
| CDR-H3 | ARAGSGNYYNWFDP | 5517 |
| CDR-L1 | RASQTVSSNLV | 5518 |
| CDR-L2 | YGASTRAT | 5519 |
| CDR-L3 | QQYNNWPPYT | 5520 |
| Internal Designation No.: 494 | | |
| CDR-H1 | AASGFTVSSNYMS | 5521 |
| CDR-H2 | VIYSGGSTFYADSVKG | 5522 |
| CDR-H3 | ARDSGDQLLDY | 5523 |
| CDR-L1 | RASQGISSYLA | 5524 |
| CDR-L2 | YAASTLQS | 5525 |
| CDR-L3 | QQLNSYPPFT | 5526 |
| Internal Designation No.: 506 | | |
| CDR-H1 | TFSGFSLSTSGVGVG | 5527 |
| CDR-H2 | LIYWDDDKRYSPSLKS | 5528 |
| CDR-H3 | AHHSLSSIFDY | 5529 |
| CDR-L1 | TGTSSDVGDYNYVS | 5530 |
| CDR-L2 | YEVSNRPS | 5531 |
| CDR-L3 | SSYTSSSTV | 5532 |
| Internal Designation No.: 511 | | |
| CDR-H1 | TVSGGSISSSSYYWG | 5533 |
| CDR-H2 | SIYYSGSTYYNPSLKS | 5534 |
| CDR-H3 | ASEKVDFWSGGPYYGMDV | 5535 |
| CDR-L1 | TGTSSDVGSYNYVS | 5536 |
| CDR-L2 | YEVSNRPS | 5537 |
| CDR-L3 | SSYTSISTLV | 5538 |
| Internal Designation No.: 540 | | |
| CDR-H1 | AASGFTFSNAWMS | 5539 |
| CDR-H2 | HIKSKTDGGTTDYAAPVKG | 5540 |
| CDR-H3 | TREPYYFDY | 5541 |
| CDR-L1 | RASQSISSWLA | 5542 |
| CDR-L2 | YKASSLES | 5543 |
| CDR-L3 | QQYNSYRYT | 5544 |
| Internal Designation No.: 549 | | |
| CDR-H1 | AASGLTVSSNYMS | 5545 |
| CDR-H2 | VIYSGGSTYYADSVKG | 5546 |
| CDR-H3 | ARSPYGGNS | 5547 |
| CDR-L1 | RTSQTIYNYLN | 5548 |
| CDR-L2 | YAASSFQN | 5549 |
| CDR-L3 | QQGYSTPLT | 5550 |
| Internal Designation No.: 553 | | |
| CDR-H1 | KASGYTFTSYGIS | 5551 |
| CDR-H2 | WISAYNGNTNYAQKLQG | 5552 |
| CDR-H3 | ARDRGYAATFGVFDY | 5553 |
| CDR-L1 | RASQSISSYLN | 5554 |
| CDR-L2 | SAASSLQS | 5555 |
| CDR-L3 | QQSYSTAFT | 5556 |

TABLE 11-2-continued

| | | SEQ ID NO |
|---|---|---|
| Internal Designation No.: 561 | | |
| CDR-H1 | AASGFTFSSYAMH | 5557 |
| CDR-H2 | VISYDGSNKYYADSVKG | 5558 |
| CDR-H3 | ARPLSGSYRSAFDI | 5559 |
| CDR-L1 | RASQSVSSNLA | 5560 |
| CDR-L2 | YGASTRAT | 5561 |
| CDR-L3 | QQYNNWPPRT | 5562 |
| Internal Designation No.: 562 | | |
| CDR-H1 | AASGFTFSSYAMH | 5563 |
| CDR-H2 | VISYDGSNKYYADSVKG | 5564 |
| CDR-H3 | ARASSGGYQGPFDP | 5565 |
| CDR-L1 | TGTSSDVGGYNYVS | 5566 |
| CDR-L2 | YDVSNRPS | 5567 |
| CDR-L3 | SSYTSSSTLLYV | 5568 |
| Internal Designation No.: 585 | | |
| CDR-H1 | AASGFTFATYAMH | 5569 |
| CDR-H2 | LISHDGSNKHYADSVKG | 5570 |
| CDR-H3 | ARESLEAAAPPFDY | 5571 |
| CDR-L1 | SGDKLGEKYAS | 5572 |
| CDR-L2 | YQDRKRPS | 5573 |
| CDR-L3 | QAWDSSNSVV | 5574 |
| Internal Designation No.: 851 | | |
| CDR-H1 | TFSGFSLSTNGVGMG | 5593 |
| CDR-H2 | LIYWDDDQFYSPSLKS | 5594 |
| CDR-H3 | AQAFYESFGFYS | 5595 |
| CDR-L1 | TRSIGSIASNYVQ | 5596 |
| CDR-L2 | FEDNERPS | 5597 |
| CDR-L3 | QSYDGSSELV | 5598 |
| Internal Designation No.: 894 | | |
| CDR-H1 | KVSGYTLPELSIH | 5599 |
| CDR-H2 | GFDPENAETIYTQKFQG | 5600 |
| CDR-H3 | ATSFVLMPAALGDYSYYYGMDV | 5601 |
| CDR-L1 | RSSQSLVHSDGNTYLS | 5602 |
| CDR-L2 | YKISNRFS | 5603 |
| CDR-L3 | MQATQFPLT | 5604 |
| Internal Designation No.: 896 | | |
| CDR-H1 | AASGFTFDDYAMH | 5605 |
| CDR-H2 | LISGDGGSTYYADSVKG | 5606 |
| CDR-H3 | VKDRGGSGWDLNHYYYGMDV | 5607 |
| CDR-L1 | RASQGISSYLA | 5608 |
| CDR-L2 | YAAYTLQS | 5609 |
| CDR-L3 | QQVKSYPLT | 5610 |
| Internal Designation No.: 923 | | |
| CDR-H1 | AASGFIFDDYDMT | 5611 |
| CDR-H2 | GISWNGGNTGYADSVKG | 5612 |
| CDR-H3 | AVIMSPIPRYSGYDWAGGAFDI | 5613 |
| CDR-L1 | QGDSLRSYYAS | 5614 |
| CDR-L2 | YDKNNRPS | 5615 |
| CDR-L3 | NSRDSSGNAVV | 5616 |
| Internal Designation No.: 936 | | |
| CDR-H1 | AGSGFTFDDYAMH | 5617 |
| CDR-H2 | GISWNSGSIGYADSVKG | 5618 |
| CDR-H3 | AKDVSYDSSGYYNNAFDI | 5619 |
| CDR-L1 | RASQGISSYLA | 5620 |
| CDR-L2 | YAASTLQS | 5621 |
| CDR-L3 | QQLYSYPVT | 5622 |
| Internal Designation No.: 970 | | |
| CDR-H1 | AASGFTFSSYWMS | 5623 |
| CDR-H2 | NINKDGSEKYYVDSVKG | 5624 |
| CDR-H3 | ARDYRYFDWLLSQIDLEIDYFDY | 5625 |
| CDR-L1 | RASQSISSYLN | 5626 |
| CDR-L2 | YAASSLQS | 5627 |
| CDR-L3 | QQSYSTPLT | 5628 |
| Internal Designation No.: 1015 | | |
| CDR-H1 | AASGFTFSSYWMH | 5629 |
| CDR-H2 | HINSDGSSTSYADSVKG | 5630 |
| CDR-H3 | ARGLRYFDLDV | 5631 |
| CDR-L1 | SGSSSNIGNNAVN | 5632 |
| CDR-L2 | FYDDLLPS | 5633 |
| CDR-L3 | AAWDDSLNGGV | 5634 |
| Internal Designation No.: 1036 | | |
| CDR-H1 | KASGGTLSSYTIS | 5635 |
| CDR-H2 | RIIPILGIADYAQKFQG | 5636 |
| CDR-H3 | ASAPKDWSSGFDYYYGMDV | 5637 |
| CDR-L1 | KSSQSLLNSDGKTYLY | 5638 |
| CDR-L2 | YEVSNRFS | 5639 |
| CDR-L3 | MQSVQLPPYT | 5640 |
| Internal Designation No.: 1037 | | |
| CDR-H1 | TFSGFSLSTSGVGVG | 5641 |
| CDR-H2 | LIYWDDDKRYSPSLKS | 5642 |
| CDR-H3 | AHHTITRINDY | 5643 |
| CDR-L1 | TATSSDVGAYNYVS | 5644 |
| CDR-L2 | YDVSKRPS | 5645 |
| CDR-L3 | SSYTSSSTV | 5646 |
| Internal Designation No.: 1075 | | |
| CDR-H1 | KVSGYTLIELSMH | 5647 |
| CDR-H2 | GFDPEDGETIYAQKFQG | 5648 |
| CDR-H3 | ATEWAYYGSGSYLGY | 5649 |
| CDR-L1 | RASQSVSSNLA | 5650 |
| CDR-L2 | YGASTRVT | 5651 |
| CDR-L3 | QQYNNWPRT | 5652 |
| Internal Designation No.: 1130 | | |
| CDR-H1 | KASGGTFSSNTIS | 5653 |
| CDR-H2 | RIIPLLGTVNYAQKFQG | 5654 |
| CDR-H3 | ARDAGGITIFGVEHYYYYMDV | 5655 |
| CDR-L1 | RASQSVSSSHLA | 5656 |
| CDR-L2 | YDASSRAT | 5657 |
| CDR-L3 | QQYGSSPPMYTF | 5658 |
| Internal Designation No.: 1135 | | |
| CDR-H1 | AASGLTFEDYAMH | 5659 |
| CDR-H2 | GISWNSGTIGYADSVKG | 5660 |
| CDR-H3 | AKDVGFGELLYYAFDI | 5661 |
| CDR-L1 | TGTSSDVGGYNYVS | 5662 |
| CDR-L2 | YDVSNRPS | 5663 |
| CDR-L3 | SSYTSSSTVV | 5664 |
| Internal Designation No.: 1139 | | |
| CDR-H1 | KASGYTFSSYEIN | 5665 |
| CDR-H2 | RMTLNSGNTGYAQNFQG | 5666 |
| CDR-H3 | ARMRSGWPTHGRPDDY | 5667 |
| CDR-L1 | SGSNSNIGSYTVN | 5668 |
| CDR-L2 | YGNNQRPS | 5669 |
| CDR-L3 | LAWDDSRNGLV | 5670 |
| Internal Designation No.: 1149 | | |
| CDR-H1 | KASGYTFASYDIN | 5671 |
| CDR-H2 | WMIPNIGNTGYAQKFQG | 5672 |
| CDR-H3 | ARVSRLFNDFGLRHEAPVDF | 5673 |
| CDR-L1 | TGSSSNIGAGYDVH | 5674 |
| CDR-L2 | YGYSSRPS | 5675 |
| CDR-L3 | QSYDSSLSVL | 5676 |

TABLE 11-2-continued

| | | SEQ ID NO |
|---|---|---|
| Internal Designation No.: 1404 | | |
| CDR-H1 | TFSGFSLSISGVGV | 5677 |
| CDR-H2 | LIYWDDDKRYSPSLKS | 5678 |
| CDR-H3 | AHSISTIFDH | 5679 |
| CDR-L1 | TATSSDVGDYNYVS | 5680 |
| CDR-L2 | FEVSDRPS | 5681 |
| CDR-L3 | SSYTTSSAV | 5682 |
| Internal Designation No.: 1444 | | |
| CDR-H1 | KASGYTFTAYYMH | 5683 |
| CDR-H2 | WINPNSDDTNYAQKFQG | 5684 |
| CDR-H3 | AREEGVFTIGDRYFDL | 5685 |
| CDR-L1 | GLSSGSVSTSYYPS | 5686 |
| CDR-L2 | YNTNTRSS | 5687 |
| CDR-L3 | VLYMGSGIWV | 5688 |
| Internal Designation No.: 1495 | | |
| CDR-H1 | TASGFTFSSYAMH | 5689 |
| CDR-H2 | VISYDGNNKYYGDSVKG | 5690 |
| CDR-H3 | AKGADTPHYSGYHFLSVGYYFYGMDV | 5691 |
| CDR-L1 | RASQSISYYLN | 5692 |
| CDR-L2 | YAASSLQS | 5693 |
| CDR-L3 | QQSYSTPFT | 5694 |
| Internal Designation No.: 1538 | | |
| CDR-H1 | AASGFTFSSYAMS | 5695 |
| CDR-H2 | GISDSGGSTYYADYVKG | 5996 |
| CDR-H3 | AKDRGNEYALTHYYYYAMDV | 5697 |
| CDR-L1 | RASQSISSYLN | 5698 |
| CDR-L2 | YAAYSLQSGVPS | 5699 |
| CDR-L3 | QQSYSTPIT | 5700 |
| Internal Designation No.: 1585 | | |
| CDR-H1 | AASGFTFSRFTLH | 5701 |
| CDR-H2 | VISYDGSNKYYADSVKG | 5702 |
| CDR-H3 | ARDPSTVTGYFDY | 5703 |
| CDR-L1 | GGDSIGSKSVH | 5704 |
| CDR-L2 | YYDNDRPS | 5705 |
| CDR-L3 | QVWDIGVV | 5706 |

Example 12

X-Ray Crystallography Analysis of Selected Anti-SARS-CoV-2 Antibodies

X-ray crystallography analysis of anti-SARS-CoV-2 Fabs 555, 481 and 488 (all RBD binders) are performed as follows. A 12 mg/mL solution of 555 Fab-RBD complex was set up in vapor diffusion sitting drops at a ratio of 1:1 with a well solution of 100 mM sodium acetate pH 4.6 and 20% PEG 10K. Crystals appeared within two days and were harvested on the 3rd day after the set up. 11.5 mg/mL solution of 481 Fab-RBD complex was set up in vapor diffusion sitting drops at a ratio of 1:1 with a well solution of 100 mM Tri-Sodium Citrate pH=5.8, and 14% PEG 4K, and 10% 2-Propanol. Crystals appeared within two days and were harvested on the 4th day after the set up. 11.7 mg/mL solution of 488 Fab-RBD complex was set up in vapor diffusion sitting drops at a ratio of 1:1 with a well solution of 100 mM HEPES pH=7.7, and 8% PEG 3350, and 200 mM L-Proline. Crystals appeared within one day and grew to their full size within two days. They were harvested on the 3rd day after the set up. Crystals were flash-frozen in liquid nitrogen following 1-minute incubation in cryoprotectant solution containing 25% glycerol in mother liquor.

Diffraction data were collected at Lilly Research Laboratories Collaborative Access Team (LRL-CAT) and beamline at Sector 31 of the Advanced Photon Source at Argonne National Laboratory, Chicago, Ill. Crystals stored in liquid nitrogen were mounted on a goniometer equipped with an Oxford Cryosystems Cryostat maintained at a temperature of 100° K. The wavelength used was 0.9793 Å collecting 900 diffraction images at a 0.2 degree oscillation angle and 0.12 seconds exposure time on a Pilatus3 S 6M detector at a distance of 392 mm. The diffraction data were indexed and integrated using auto PROC/XDS and merged and scaled in AIMLESS from the CCP4 suite (Vonrhein, *Acta Crystallogr D Biol Crystallogr* 67, 293-302, 2011; Kabsch, *Acta crystallographica. Section D, Biological crystallography* 66, 133-144, 2010; Evans, *Acta Crystallogr D Biol Crystallogr* 69, 1204-1214, 2013; Winn, *Acta crystallographica. Section D, Biological crystallography* 67, 235-242, 2011).

Non-isomorphous data readily yielded initial structures by Molecular Replacement using for the Fab portion crystal structures from the proprietary Eli Lilly structure database and for the SARS2 Spike RBD the public domain structure with the access code 6yla (Huo et al., "Neutralization of SARS-CoV-2 by Destruction of the Prefusion Spike." *Cell Host and Microbe* 28(3): 445-454 (2020)). The initial structure coordinates for each dataset were further refined using Refmac5 (CCP4) applying isotropic temperature factors. Model building was performed with Coot (CCP4) and final structure validation with MolProbity (Chen et al., *Acta Crystallogr D Biol Crystallogr* 66: 12-21, 2010) and CCP4 validation tools.

Figure 9A:
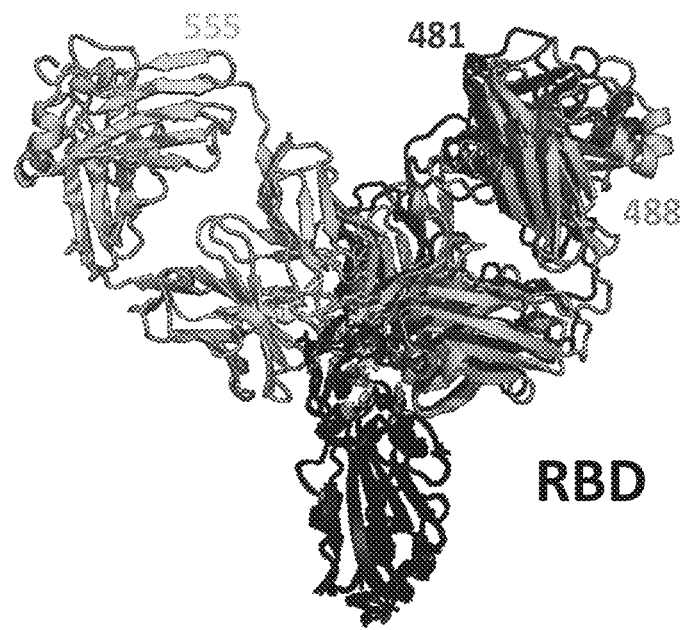
FIG. 9A is a ribbon diagram of Fab of LY-CoV555/481/488: RBD domain complex structured as determined by X-ray crystallography.
Figure 9B:
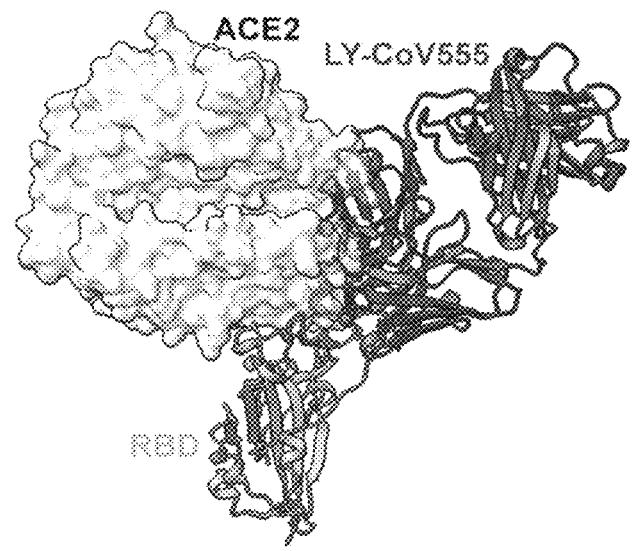
FIG. 9B shows the crystal structure of the RBD-Fab of LY-CoV555 complex superimposed with the ACE2 receptor from a structure of the RBD-ACE2 complex (PDB ID: 6MOJ).
Figure 9C:
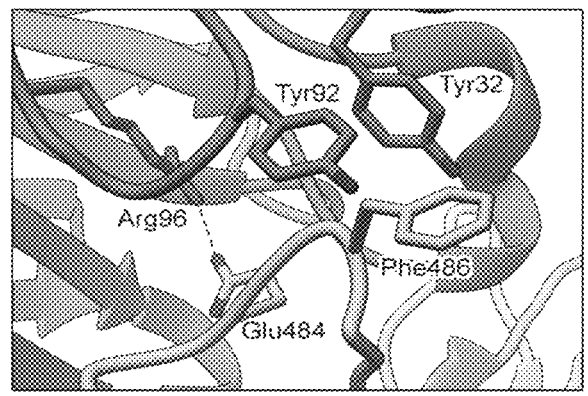
FIG. 9C is a zoomed-in view of key atomic interactions at the interface of the Fab of LY-CoV555 light chain and the RBD of SARS-CoV-2 Spike protein.
Figure 9D:
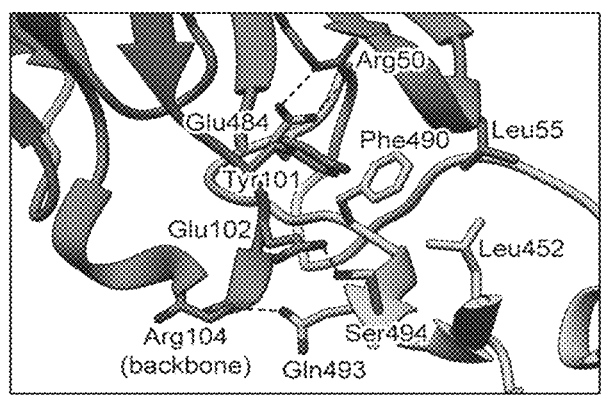
FIG. 9D is a zoomed-in view of key atomic interactions at the interface of the Fab of LY-CoV555 heavy chain and the RBD of SARS-CoV-2 Spike protein.
Figure 9E:
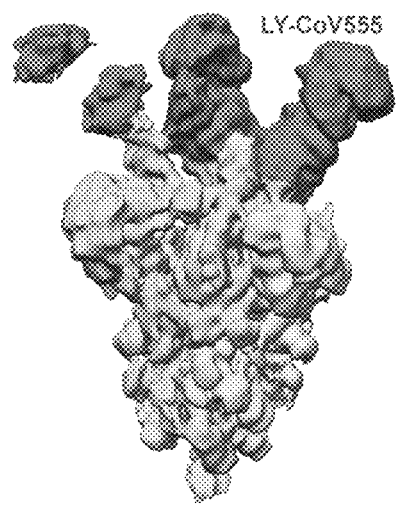
FIG. 9E shows the cryo-EM structure of the Fab of LY-CoV 555-Spike protein complex low-pass filtered to 8 Å resolution and shown at low threshold in order to visualize all three Fabs.
Figure 9F:
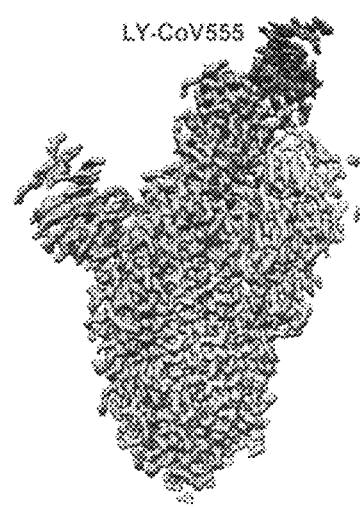
FIG. 9F is a high-resolution cryo-EM map of the Fab of LY-CoV555-Spike protein complex.
Figure 10A:
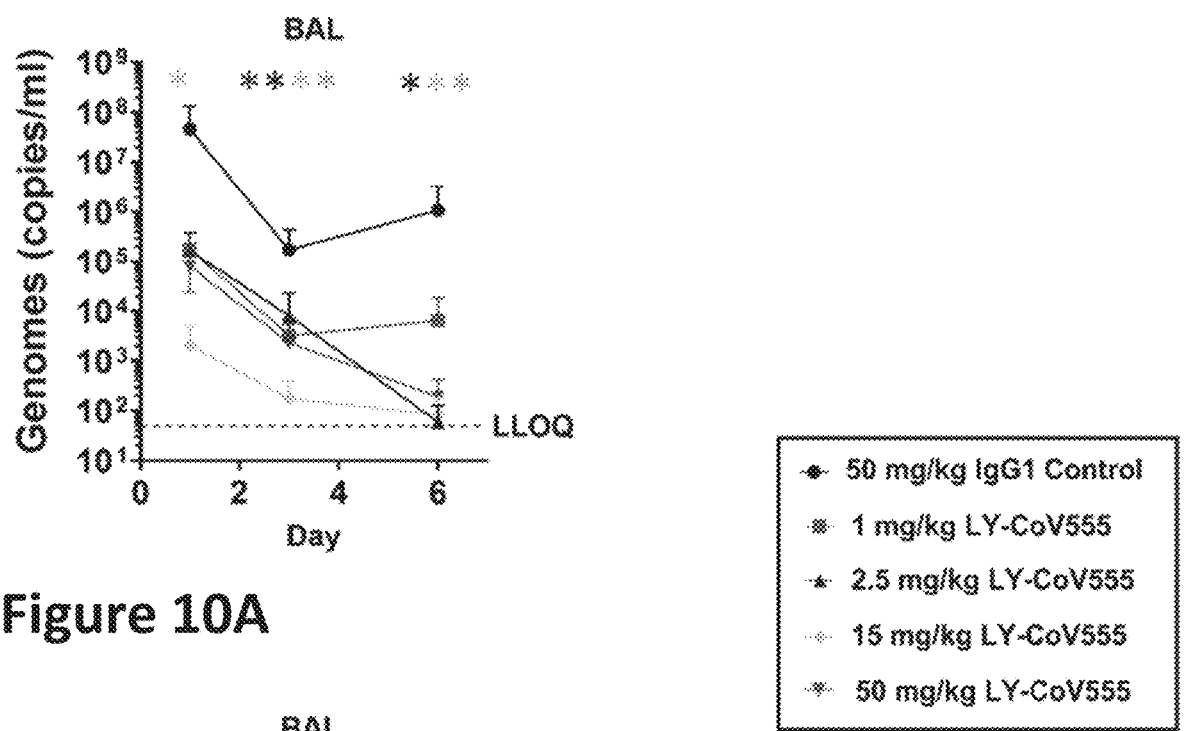
FIGS. 10A-10H show the effect of mAb 555 (aka LY-CoV555) on the viral loads in rhesus macaques challenged with SARS-CoV-2. 24 hours prior to viral challenge, Rhesus macaques were administered varying amounts of LY-CoV555 as a single IV dose. Viral loads in the BAL (FIGS. 10A and 10B), throat swabs (FIGS. 10C and 10D), nasal swabs (FIGS. 10E and 10F) or lung tissue (FIGS. 10G and 10H) were assessed over the course of 6 days post-inoculation by measuring genomic RNA (FIGS. 10A, 10C, 10E, 10G) or subgenomic mRNA (FIGS. 10B, 10D, 10F, 10H) by qRT-PCR.
Figure 10B:
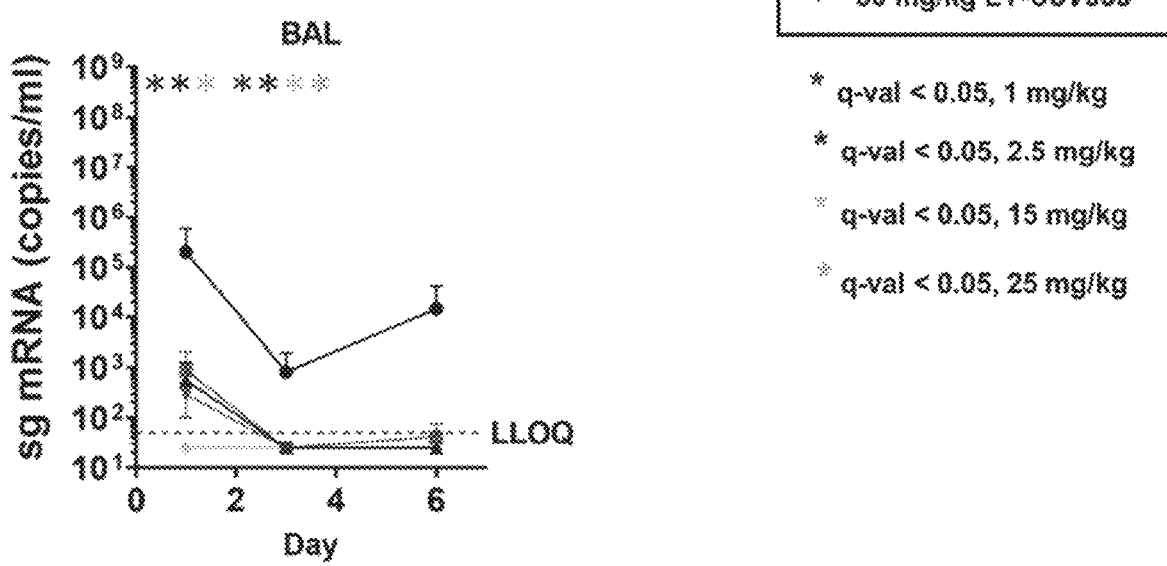
Figure 10C:
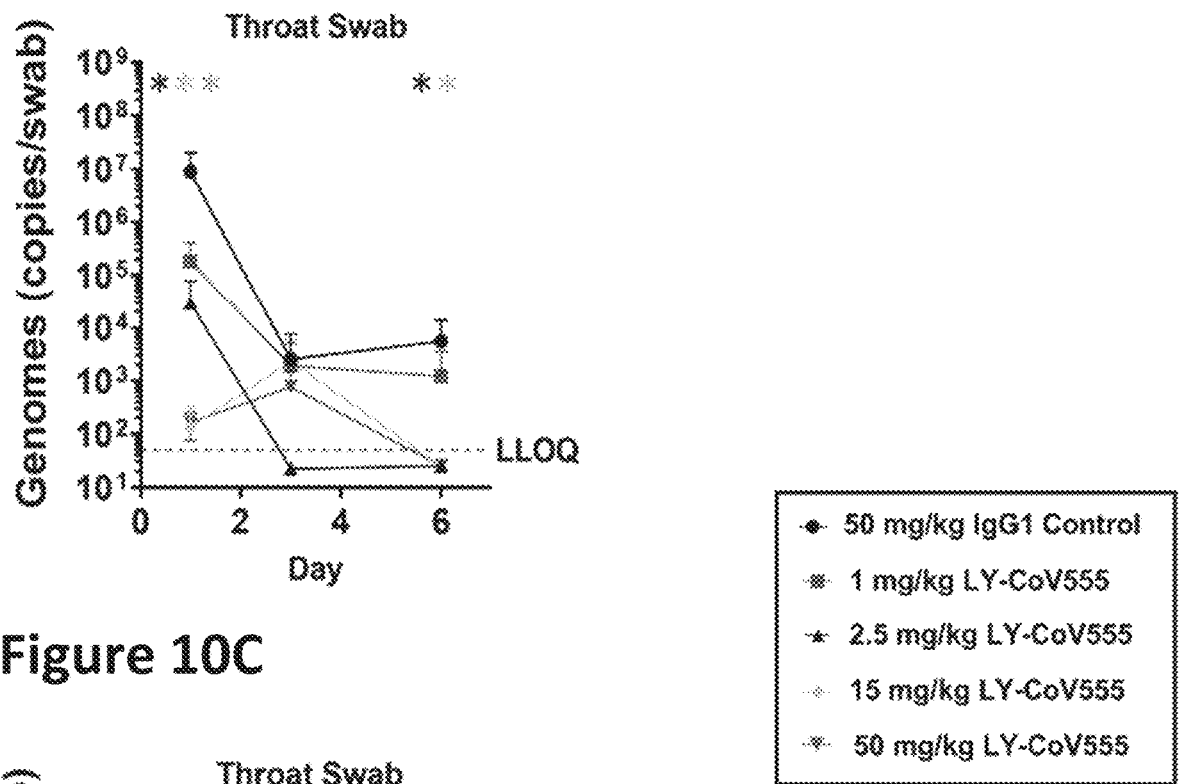
Figure 10D:
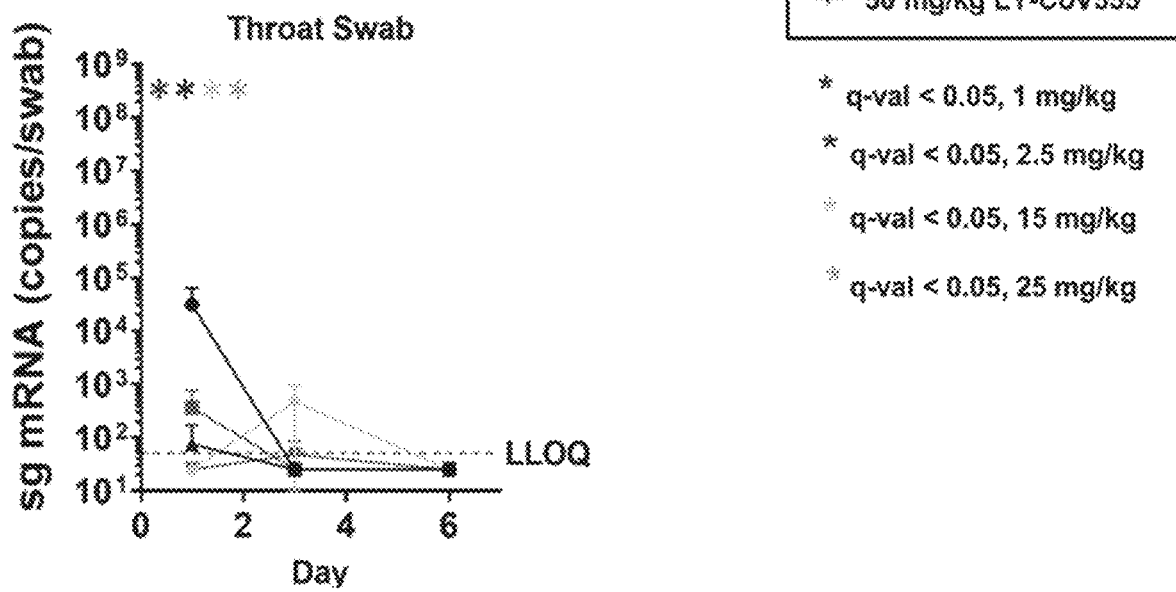
Figure 10E:
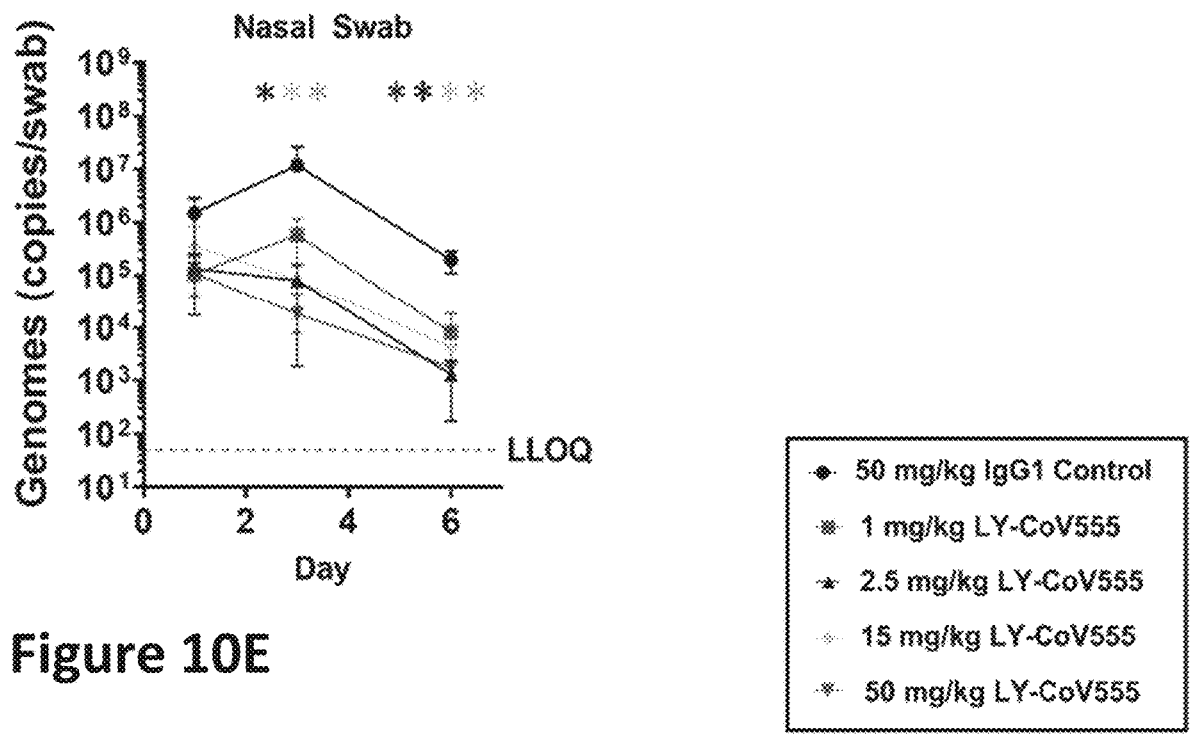
Figure 10F:
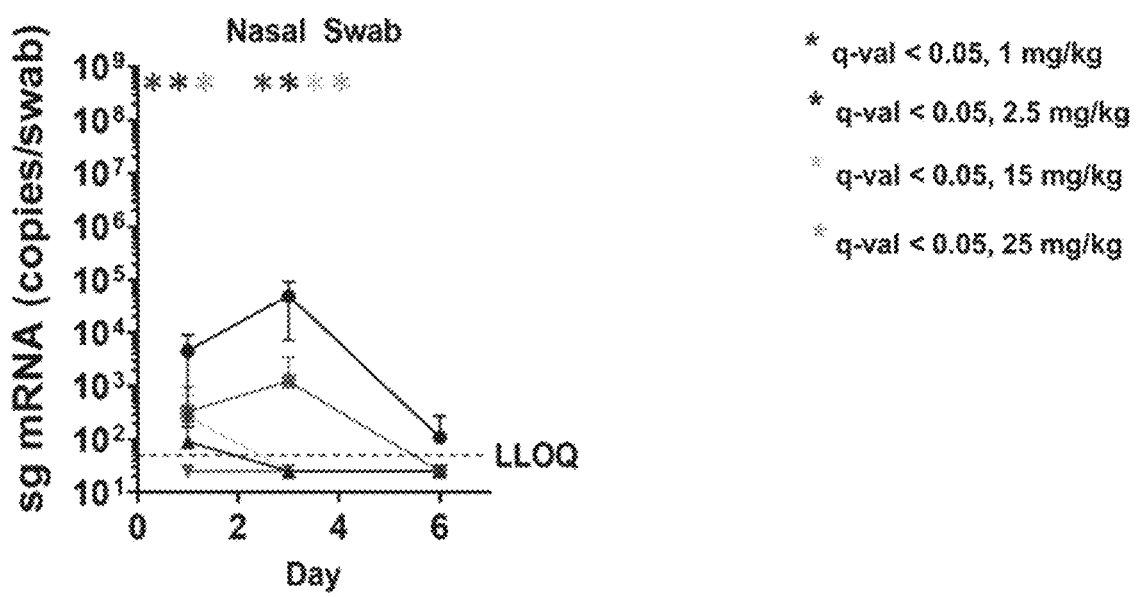
Figure 10G:
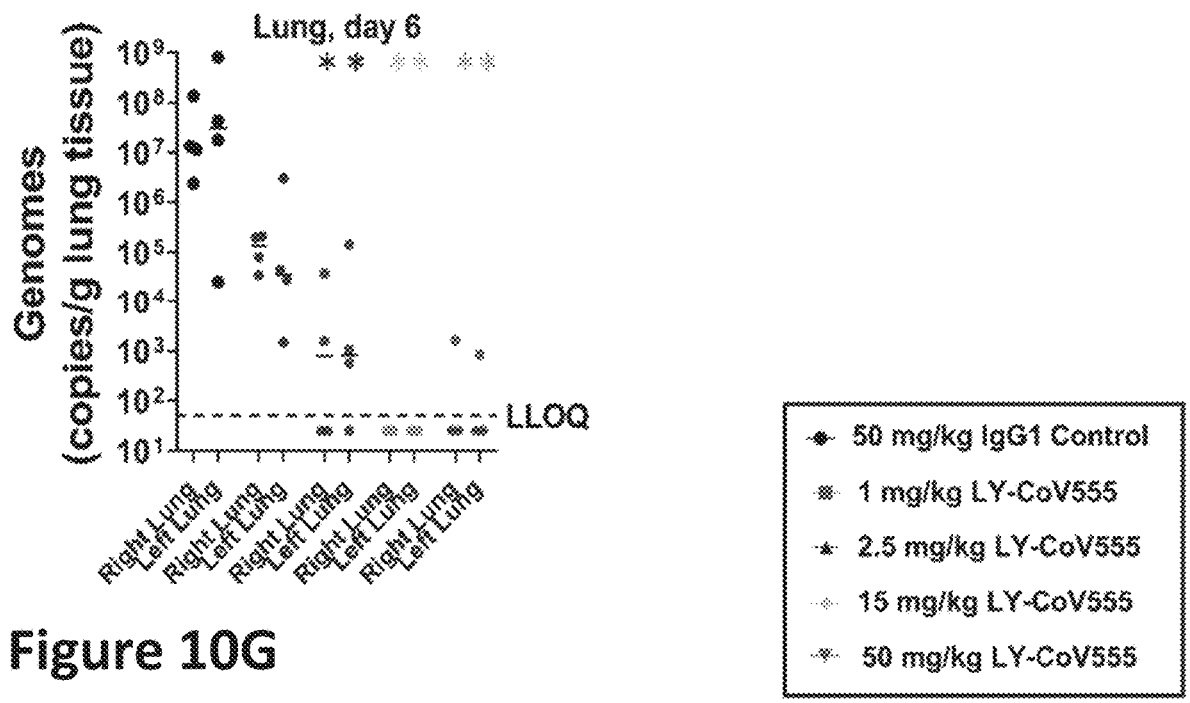
Figure 10H:
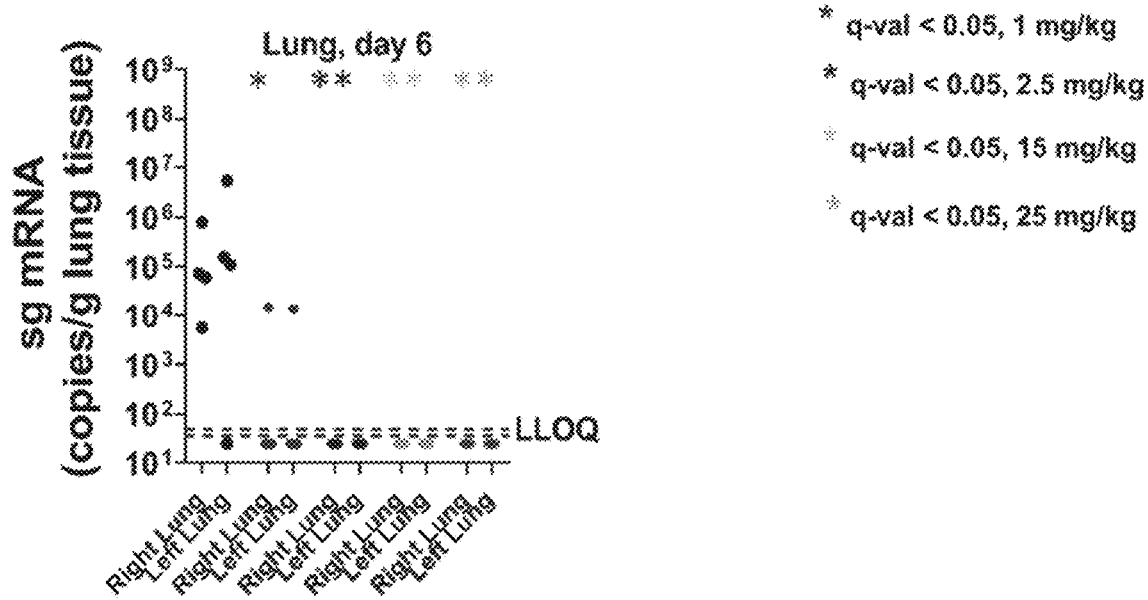

The crystal structures of Fabs 481, 488 and 555, in complex with the SARS-CoV-2 Spike protein RBD are shown in FIG. 9A. Fabs 481 and 488 bind in a nearly identical fashion almost completely obscuring the ACE2 binding site. This binding site is expected to be accessible in the "up" conformation of the RBD. Fab 555 binds to a different epitope on RBD that is slightly overlapping with the ACE2 binding site (FIG. 9B). The epitope of Fab 555 (FIGS. 9C and 9D) is predicted to be fully accessible on both the "up" and the "down" conformation of the RBD. This prediction is confirmed by high resolution cryo-EM imaging in which complexes of three 555 Fabs bound to a single SARS-CoV-2 Spike protein are observed in both the up and down conformation (FIGS. 9E and 9F).

Detailed epitope analysis for Fabs 555, 481 and 488 are performed as follows. Molecular operating environment (MOE) software from Chemical Computing Group (CCG), is used to measure contact surface areas (using the molecular contact surface analysis SVL script) and generate figures. CCP4 contact software is used to identify the number of van der Waals and hydrogen bonding interactions (numbers in parentheses, respectively, in Tables 12.1, 12.2 and 12.3). A distance cutoff of 3.5 Å (angstroms) was used for hydrogen bonding interactions, and 4.5 Å for van der Waals contacts. SARS-CoV-2 Spike protein residues with at least one atom that is within 4.5 Å to any residue of the antibody/Fab is considered part of the epitope for the antibody/Fab.

As shown in Table 12.1, the epitope of Fab/mAb 555 comprises one or more of the following amino acid residues of SARS-CoV-2 Spike protein: Y351, Y449, N450, L452, L455, F456, T470, I472, N481, G482, V483, E484, G485, F486, Y489, F490, L492, Q493, 5494 (the residue positions correspond to SEQ ID NO: 5317).

As shown in Table 12.2, the epitope of Fab/mAb 481 comprises one or more of the following amino acid residues of SARS-CoV-2 Spike protein: R403, D405, R408, Q409, T415, G416, K417, D420, Y421, Y453, L455, F456, R457, K458, 5459, N460, Y473, Q474, A475, G476, F486, N487, Y489, Q493, S494, Y495, G496, Q498, T500, N501, G502, Y505 (the residue positions correspond to SEQ ID NO: 5317).

As shown in Table 12.3, the epitope of Fab/mAb 481 comprises one or more of the following amino acid residues of SARS-CoV-2 Spike protein: R403, T415, G416, K417, D420, Y421, L455, F456, R457, K458, S459, N460, Y473, Q474, A475, G476, 5477, F486, N487, Y489, N501, G502, Y505 (the residue positions correspond to SEQ ID NO: 5317).

TABLE 12.1

Interactions between SARS-CoV-2 Spike protein residues and Fab 555 residues

| Residues of SARS-CoV-2 Spike protein | Residues of Fab 555: HC; LC | % dSA* |
|---|---|---|
| Y351 | L55 (1) | 36.2 |
| Y449 | S30 (1), N31 (15) | 49.3 |
| N450 | K74 (1) | 13.4 |
| L452 | L55 (3) | 53.3 |
| L455 | A103 (1) | 47 |
| F456 | A103 (2) | 25.8 |
| T470 | L55 (1), 157 (5) | 56.6 |
| 1472 | R50 (1) | 18.6 |
| N481 | T94 (4) | 34.4 |
| G482 | R50 (2, 1), N59 (7, 2) | 55.5 |
| V483 | W47 (2), R50 (1), N59 (2) | 87.2 |
| E484 | R50 (7, 3), 152 (2), Y101 (6), Y110 (14), R96 (5, 1) | 98.6 |
| G485 | Y110 (11), S91 (1), Y32 (5), Y92 (3) | 97.8 |
| F486 | Y32 (17), Y92 (28, 1) | 65.9 |
| Y489 | Y110 (2), Y32 (2) | 37.6 |
| F490 | 152 (5), 157 (2), L55 (2), Y101 (8) | 90.7 |
| L492 | L55 (1) | 72.2 |
| Q493 | A103 (4, 1), E102 (15), R104 (7, 1) | 81.4 |
| S494 | E102 (4, 2), N31 (1, 1) | 65.2 |
| Total: | 224 (211 vdW, 13 H-bonds) | 583; Å^2 |

*% ΔSA is percentage of the sidechain total surface area, which indicates the change in solvent exposed surface area. For each residue of the Fab, the number of specific atom-atom contacts is shown in parentheses, including both van der Waal (vdW), and hydrogen bonds (Hbond).

TABLE 12.2

Interactions between SARS-CoV-2 Spike protein residues and Fab 481 residues

| Residues of SARS-CoV-2 Spike protein | Residues of Fab 481: HC; LC | % ΔSA* |
|---|---|---|
| R403 | F94 (2), N92 (7, 2); S93 (1) | 56.6 |
| D405 | F94 (1) | 10.9 |
| R408 | F94 (3) | 10.6 |
| Q409 | F94 (2) | 21 |
| T415 | S56 (5), F58 (8) | 49 |
| G416 | Y52 (3), F58 (5) | 100 |
| K417 | Y33 (5), Y52 (8) | 44.9 |
| D420 | Y52 (2), S56 (4, 2) | 59.7 |
| Y421 | Y33 (4), Y52 (8), P53 (4), G54 (6, 1) | 73.3 |
| Y453 | W32 (2) | 27.9 |
| L455 | Y33 (10, 1), A100 (3) | 75.7 |
| F456 | Y33 (4), V99 (1) | 50.8 |
| R457 | P53 (4) | 19.7 |
| K458 | S31 (4), S31 (4), G54 (3), P53 (3, 1) | 33.2 |
| S459 | G54 (1) | 12.3 |
| N460 | G54 (6) | 36 |
| Y473 | S31 (9, 1), P53 (2) | 47.8 |
| Q474 | S31 (1) | 11.1 |
| A475 | F27 (3), T28 (6, 1), S31 (3), N32 (6, 1), R97 96.2 (1) | |
| G476 | F27 (2), T28 (4) | 52.8 |

TABLE 12.2-continued

Interactions between SARS-CoV-2 Spike protein residues and Fab 481 residues

| Residues of SARS-CoV-2 Spike protein | Residues of Fab 481: HC; LC | % ΔSA* |
|---|---|---|
| F486 | V2 (3), G26 (2), R97 (3), Y105 (6) | 31.9 |
| N487 | G26 (2, 1), F27 (4), R97 (3, 2) | 63.4 |
| Y489 | R97 (3, 1), V99 (6) | 52.8 |
| Q493 | A100 (2), W32 (4) | 42.7 |
| S494 | W32 (3) | 27.3 |
| Y495 | W32 (4, 1) | 30.7 |
| G496 | S30 (2, 1) | 41.3 |
| Q498 | S30 (12, 1), S67 (3, 2) | 56.8 |
| T500 | G28 (3, 1), G68 (1) | 27.2 |
| N501 | G28 (12), I29 (1), S30 (3, 1) | 53.9 |
| G502 | G28 (4, 2), Q27 (7) | 88 |
| Y505 | G28 (2), 12 (5), 129 (2), N92 (11), Q90 (5, 1), S93 (2) | 66.8 |
| Total | vdW: 272; H-bonds: 24 | 815 Å^2 |

*% ΔSA is percentage of the sidechain total surface area, which indicates the change in solvent exposed surface area. For each residue of the Fab, the number of specific atom-atom contacts is shown in parentheses, including both van der Waal (vdW), and hydrogen bonds (Hbond).

TABLE 12.3

Interactions between SARS-CoV-2 Spike protein residues and Fab 488 residues

| Residues of SARS-CoV-2 Spike protein | Residues of Fab 488: HC; LC | % ΔSA* |
|---|---|---|
| R403 | D92 (3, 2), N93 (2, 1) | 46.7 |
| T415 | S56 (4), Y58 (8, 2) | 46 |
| G416 | Y52 (2), Y58 (4, 1) | 89.6 |
| K417 | Y33 (5), Y52 (6), Y100 (8, 1) | 57.4 |
| D420 | Y52 (2), S56 (4, 2) | 61 |
| Y421 | Y33 (3), Y52 (8), S53 (5, 1), 54 (6, 1) | 72.7 |
| L455 | Y33 (6, 1), Y100 (11) | 68.3 |
| F456 | Y33 (4), G101 (3), Y100 (4) | 46.4 |
| R457 | S53 (2, 1) | 23.2 |
| K458 | T28 (1), S30 (6, 2), S31 (5, 1), S53 (8, 1), G54 (3) | 47 |
| S459 | G54 (3) | 16.3 |
| N460 | G54 (7) | 37.9 |
| Y473 | S31 (9, 1), S53 (1) | 45.8 |
| Q474 | S31 (1) | 12.1 |
| A475 | L27 (3), T28 (6, 1), S31 (3), N32 (7, 1), R97 (1) | 96.8 |
| G476 | L27 (2), T28 (6, 1) | 56.3 |
| S477 | T28 (1) | 12.9 |
| F486 | V2 (2), R97 (2) | 21.3 |
| N487 | G26 (2, 1), L27 (3), R97 (3, 2) | 60.9 |
| Y489 | N32 (1), R97 (3, 2), G101 (5), G102 (2, 1) | 52.1 |
| N501 | D28 (4) | 23.1 |
| G502 | D28 (6, 1) | 64.6 |
| Y505 | D28 (9), I29 (8), S30 (5), Y32 (5), D92 (5, 1), N93 (6, 1) | 72 |
| Total | vdW: 244; H-bonds: 30 | 671 Å^2 |

*% ΔSA is percentage of the sidechain total surface area, which indicates the change in solvent exposed surface area. For each residue of the Fab, the number of specific atom-atom contacts is shown in parentheses, including both van der Waal (vdW), and hydrogen bonds (Hbond).

Example 13

Rhesus Macaque Model of SARS-CoV-2 Infection

To assess the ability of mAb 555 (also known as LY-CoV555) to protect from viral challenge, rhesus macaques were intravenously (IV) administered with 1 mg/kg, 2.5 mg/kg, 15 mg/kg, or 50 mg/kg of mAb 555 or 50 mg/kg of an IgG1 control antibody 24 hours prior to virus challenge. Rhesus macaques were inoculated intranasally and intratracheally with a total of $1.1 \times 10^5$ $TCID_{50}$ of SARS-CoV-2 (USA-WA1/2020) and were monitored by twice daily cage-side observations, and respiratory exams throughout the study. Respiratory and clinical signs of disease in the macaques were limited, and gross necropsy observations collected at Day 6 were mild. Bronchoalveolar lavage (BAL) fluid, nasal and throat swabs were collected on Days 1, 3, and 6 after viral challenge (study Day 0). Viral genomes (gRNA) and subgenomic RNA (sg mRNA), indicative of active viral replication, were detectable in BAL, throat swabs, and nasal swabs for all animals following intranasal and intratracheal inoculation with SARS-CoV-2 (FIGS. 10A-10H).

Substantial reduction in viral loads was demonstrated in the upper and lower respiratory tracts of all LY-CoV555-treated groups (FIGS. 10A, 10C, 10E, 10G and Table 13.1). In the BAL and throat swabs, LY-CoV555 treatment resulted in 1.5 to 5-log reduction in gRNA 1-day post inoculation, with significance (q-value <0.05) at 15 mg/kg (BAL) and 2.5, 15, and 50 mg/kg (throat). The 2.5, 15, and 50 mg/kg doses of LY-CoV555 demonstrated significant reductions (q-value <0.05) in BAL and nasal gRNA on Days 3 and 6. Consistent with the BAL gRNA, Day 6 lung tissue also demonstrated significant (q-value <0.05) reduction in gRNA at doses of LY-CoV555 of 2.5 mg/kg and above. Overall reductions in gRNA were dose-related, with maximal protection observed at doses of 2.5 mg/kg and above. In addition to viral load determination, BAL samples from Days 3 and 6 were subjected to whole genome sequencing by next generation sequencing. Of the samples with sufficient coverage to identify genomic variants (N=12), no sequence alterations were detected in the LY-CoV555 or RBD domains compared to the reference (Table 13.1).

Subgenomic RNA analysis demonstrated profound impact of LY-CoV555 treatment on viral replication (FIGS. 10B, 10D, 10F, 10H and Table 13.1). In Day 1 BAL, throat, and nasal samples, 1-4 log reduction in sgRNA was seen for all LY-CoV555 treated groups, with significance (q-value <0.05) observed in all groups in the throat, and at 1, 2.5 and 15 or 50 mg/kg groups in BAL and nasal samples. Notably, by Day 3 sgRNA in the BAL and nasal samples was undetectable in animals dosed with 2.5-50 mg/kg LY-CoV555, with significant 3-4 log reductions observed relative to control (q-value <0.05). At Day 6, significant reduction of sgRNA in the lung tissue was demonstrated (q-value<0.05), at 2.5 through 50 mg/kg dose levels. Overall, these data show potent neutralization of SARS-CoV-2 in a non-human primate model by mAb 555.

To support dose-response evaluation of the model, serum concentrations of LY-CoV555 were determined evaluated by ELISA. LY-CoV555 demonstrated sustained serum concentrations after IV administration, consistent with expected pharmacokinetics for human IgG in a non-human primate model (Table 13.2). The dose responsive concentrations of serum LY-CoV555 were consistent with the dose-related reductions in viral loads in the lungs, throat, and nasal passages. Importantly, serum concentrations of LY-CoV555 at doses of 2.5 mg/kg and higher were associated with maximal protection in this Rhesus macaques infection model, and clearly demonstrate potent in vivo activity at low mg/kg dose levels. The delayed impact on viral loads in nasal swabs could reflect slower distribution of antibody into the nasal epithelial lining fluid versus the lung or throat.

TABLE 13.1

Statistical analyses for impact of mAb 555 (LY-CoV555) on viral loads in SARS-CoV-2 challenged Rhesus macaques.

| | | BAL | | Throat Swab | | Nasal Swab | | Right Lung | | Left Lung | |
|---|---|---|---|---|---|---|---|---|---|---|---|
| | | Genomes q-val | g mRNA q-val | Genomes q-val | g mRNA q-val | Genomes q-val | g mRNA q-val | Genomes q-val | g mRNA q-val | Genomes q-val | g mRNA q-val |
| Day 1 | 1 mg/kg | 0.159 | 0.037 | 0.084 | 0.008 | 0.207 | 0.023 | | | | |
| | 2.5 mg/kg | 0.069 | 0.038 | 0.005 | 0.002 | 0.186 | 0.010 | | | | |
| | 15 mg/kg | 0.008 | 0.007 | 0.001 | 0.002 | 0.454 | 0.090 | | | | |
| | 50 mg/kg | 0.258 | 0.194 | 0.002 | 0.002 | 0.210 | 0.008 | | | | |
| Day 3 | 1 mg/kg | 0.022 | 0.010 | 0.730 | 0.921 | 0.069 | 0.005 | | | | |
| | 2.5 mg/kg | 0.008 | 0.008 | 0.075 | 0.921 | 0.008 | 0.002 | | | | |
| | 15 mg/kg | 0.007 | 0.015 | 0.794 | 0.094 | 0.031 | 0.002 | | | | |
| | 50 mg/kg | 0.019 | 0.012 | 0.814 | 0.727 | 0.005 | 0.002 | | | | |
| Day 6 | 1 mg/kg | 0.192 | 0.674 | 0.250 | 0.921 | 0.027 | 0.578 | 0.137 | 0.010 | 0.137 | 0.080 |
| | 2.5 mg/kg | 0.007 | 0.317 | 0.036 | 0.921 | 0.005 | 0.418 | 0.005 | 0.004 | 0.015 | 0.028 |
| | 15 mg/kg | 0.011 | 0.317 | 0.037 | 0.794 | 0.038 | 0.607 | 0.002 | 0.005 | 0.005 | 0.037 |
| | 50 mg/kg | 0.028 | 0.455 | 0.054 | 0.864 | 0.002 | 0.603 | 0.005 | 0.008 | 0.006 | 0.031 | q-values in bold represent values < 0.05, and indicate statistical significance.

TABLE 13.2

Serum total human IgG concentrations and AUC0-6 days following intravenous administration of mAb 555 or control IgG to Rhesus Macaques in SARS-CoV-2 challenge model.

| | | Serum concentration (mcg/mL) | | | | |
|---|---|---|---|---|---|---|
| | | Day 0* | Day 1 | Day 3 | Day 6 | $AUC_{0-Day\ 6}$ (mcg * hr / mL) |
| Group 1: 50 mg/kg | mean | 667 | 348 | 164 | 88 | 57500 |
| IgG1 control (N = 4) | stdev | 115 | 71 | 52 | 32 | 8360 |
| Group 2: 1 mg/kg | mean | 15 | 13 | 10 | 8 | 1920 |

TABLE 13.2-continued

Serum total human IgG concentrations and AUC0-6 days following intravenous administration of mAb 555 or control IgG to Rhesus Macaques in SARS-CoV-2 challenge model.

| | | Serum concentration (mcg/mL) | | | | AUC$_{0\text{-}Day\,6}$ (mcg * hr / mL) |
|---|---|---|---|---|---|---|
| | | Day 0* | Day 1 | Day 3 | Day 6 | |
| LY-CoV555 (N = 4) | stdev | 3 | 3 | 2 | 1 | 356 |
| Group 3: 2.5 mg/kg | mean | 38 | 30 | 21 | 15 | 4310 |
| LY-CoV555 (N = 4) | stdev | 14 | 11 | 6 | 3 | 1380 |
| Group 4: 15 mg/kg | mean | 276 | 215 | 145 | 98 | 30900 |
| LY-CoV555 (N = 3) | stdev | 37 | 14 | 21 | 13 | 3190 |
| Group 5: 50 mg/kg | mean | 679 | 539 | 376 | 258 | 77800 |
| LY-CoV555 (N = 3) | stdev | 101 | 61 | 47 | 78 | 12000 |

Abbreviations: AUC0-Day6 = area under the concentration time curve. N = number of animals per group.
*Day of viral challenge.

Methods for Rhesus Macaques Studies

The rhesus macaque model of SARS-CoV-2 infection was conducted according to the method of Chandrashekar et al., Science 2020. This study was approved by the Institutional Animal Care and Use Committee of BioQual Inc. in accordance with the animal welfare requirements and accreditations. Housing and handling of the animals was performed in accordance with the standards of the AAALAC International's reference resource: the eighth edition of the *Guide for the Care and Use of Laboratory animals*, Animal Welfare Act as amended, and the 2015 reprint of the Public Health Service (PHS) Policy on Human Care and Use of Laboratory Animals. Handling of samples and animals was compliance with the Biosafety in Microbiological and Biomedical Laboratories (BMBL), 5th edition (Centers for Disease Control). Naïve female rhesus macaques of Indian origin (purpose bred, *Macaca mulatta* from PrimGen 8-12 years of age) were administered at 1, 2.5, 15 or 50 mg/kg of LY-CoV555 or 50 mg/kg of an IgG1 control antibody by slow intravenous bolus (N=3 or 4 animals per group). On study day 0 (one day following antibody administration), monkeys received a viral challenge of 1.1×10^5 PFU SARS-CoV-2 USA-WA1/2020 in 2 mL volume administered divided as 0.5 mL/nostril (IN) and 1.0 mL intratracheally (IT). Live phase parameters were monitored pre-study through necropsy (Day 6). COVID specific observations were collected daily in conscious animals to monitor overall health and welfare and determine the need for veterinary intervention and/or euthanasia. COVID observations were scored on a scale of 0 to 10 and included measures of respiratory rate and dyspnea, overall appearance, activity, and responsiveness. Clinical observations were assessed cage-side twice daily and included evaluations of overall animal appearance, fecal consistency, and appetence. Body weights and rectal body temperatures were measured daily in anesthetized animals. At termination on study Day 6, macroscopic observations in the lung were evaluated by a board-certified veterinary pathologist.

Bronchioalveolar lavage (BAL), nasal and oral swabs were collected on days 1, 3 and 6, and lung tissue samples (at necropsy, day 6) were collected to assess genomic and subgenomic viral RNA via qRT PCR, conducted as reported (Chandrashekar et al, Science 2020). The lower limit of detection for genomic and sub-genomic RNA copies was 50. Where values were below the lower limit of detection in the assay, a value of 25 (½ the limit of quantitation) was used for calculations. Serum samples were also collected for determination of LYCoV-555 concentrations by total human IgG ELISA assay.

Example 14

Characterization of Additional Anti-SARS-CoV-2 Antibodies

Additional anti-SARS-CoV-2 antibodies were characterized using the methods described in Examples 3-6, 9, and 10. The Spike protein binding, ACE2 blocking, and binding affinity determination were performed using methods described in Example 4. The pseudoneutralization assay was performed using methods described in Example 6. Competitive binding assays were performed using methods similar to the epitope binning assays described in Example 4. The results are shown in Table 14-1.

The live virus neutralization assay was performed at Lab 4 using cultured Vero E6 cells infected with the SARS-CoV-2 virus clinical isolate USA/WA/1/2020. Pre-mixed solution of the SARS-CoV-2 virus and the tested anti-SARS-CoV-2 antibody were added to the Vero E6 cells and incubated at 37° C. for 24 hours to allow the non-neutralized SARS-CoV-2 virus to replicate. Decreased production of viral nucleocapsid protein as detected using standard immunostaining techniques. IC$_{50}$ were calculated and the results are shown in Table 14-1.

TABLE 14-1

Activities of selected anti-SARS-CoV-2 mAbs

| mAb ID | Spike Domain Bound | ACE2 Blocking? | Binding Affinity to to WT Spike | Binding Affinity to D614G Spike | Pseudo-neutralization IC$_{50}$ (μg/mL) | Live Virus Neutralization IC5$_0$ (μg/mL) | Compete with 555 for binding? | Compete with 488 for binding? |
|---|---|---|---|---|---|---|---|---|
| 923 | RBD | Yes | 35 pM | 22 pM | 0.093 | N/A | No | Yes |
| 933 | RBD | Yes | 276 pM | 29 nM | 0.022 | N/A | No | Yes |
| 966 | RBD | No | 1.8 nM | 1.3 nM | 0.021 | >10 | No | No |
| 989 | RBD | No | 104 pM | 39 pM | 0.19 | 1.5 | No | No |
| 1000 | RBD | Yes | 92 pM | 16 pM | 0.006 | 0.013 | Yes | Yes |

TABLE 14-1-continued

Activities of selected anti-SARS-CoV-2 mAbs

| mAb ID | Spike Domain Bound | ACE2 Blocking? | Binding Affinity to to WT Spike | Binding Affinity to D614G Spike | Pseudo-neutralization IC$_{50}$ (µg/mL) | Live Virus Neutralization IC5$_0$ (µg/mL) | Compete with 555 for binding? | Compete with 488 for binding? |
|---|---|---|---|---|---|---|---|---|
| 1009 | RBD | Yes | 168 pM | 34 pM | 0.17 | N/A | No | No |
| 1012 | RBD | Yes | 139 pM | 27 pM | 0.006 | 0.028 | Yes | Yes |
| 1015 | RBD | Yes | 96 pM | 20 pM | 0.011 | 0.032 | Yes | No |
| 1027 | RBD | Yes | 205 pM | 43 pM | 0.01 | 0.005 | Yes | Yes |
| 1037 | RBD | Yes | 126 pM | 23 pM | 0.025 | 0.009 | No | No |
| 1075 | NTD | No | 93 pM | 23 pM | 0.039 | 0.011 | N/A | N/A |
| 1081 | RBD | No | 93 pM | 41 pM | 0.012 | 4.6 | No | No |
| 1091 | RBD | No | 54 pM | 19 pM | 0.016 | 0.074 | Yes | No |
| 1098 | RBD | No | 173 pM | 22 pM | 0.087 | N/A | No | No |
| 1118 | RBD | Yes | 223 pM | 44 pM | 0.026 | N/A | Yes | Yes |
| 1130 | NTD | Yes | 94 pM | 40 pM | 0.114 | 2.3 | N/A | N/A |
| 1193 | NTD | Yes | 178 pM | 41 pM | 0.69 | 0.31 | N/A | N/A |
| 1203 | RBD | Yes | 302 pM | 79 pM | 0.02 | N/A | No | Yes |

Example 15

Plaque Reduction Neutralization Tests

Vero 76/E6 cells were seeded in a 24-well plate 48 hours before the assay. Seventy-five plaque forming units (pfu) of infectious clone hCoV-19/Canada/ON_ON-VIDO-01-2/202 were mixed with serial dilutions of select anti-corona antibodies and incubated at 37° C. for 60 minutes. Virus and antibody mix was added to each well and incubated for 1 h in a 37° C.+5% $CO_2$ incubator with rocking every 10-15 min. Plaque assay media (complete MEM media with 1% BGS+1% low melting point agarose) was overlaid on top of the inoculum and incubated at 37° C.+5% $CO_2$ incubator for 48 hours. For plaque visualization, an MEM-Neutral Red overlay was added on day 2 and plaques counted manually on day 3 or day 4. Results are shown in Table 15-1.

TABLE 15-1

IC$_{50}$ values for select anti-coronavirus antibodies

| Antibody ID | IC$_{50}$ (µg/mL) |
|---|---|
| 555 | 0.0083 |
| 923 | 0.0100 |
| 970 | 0.2854 |
| 1037 | 0.0096 |
| 1075 | 0.4087 |
| 1404 | 0.0034 |
| 1495 | 0.0292 |
| 1538 | 0.0946 |

Figure 11:
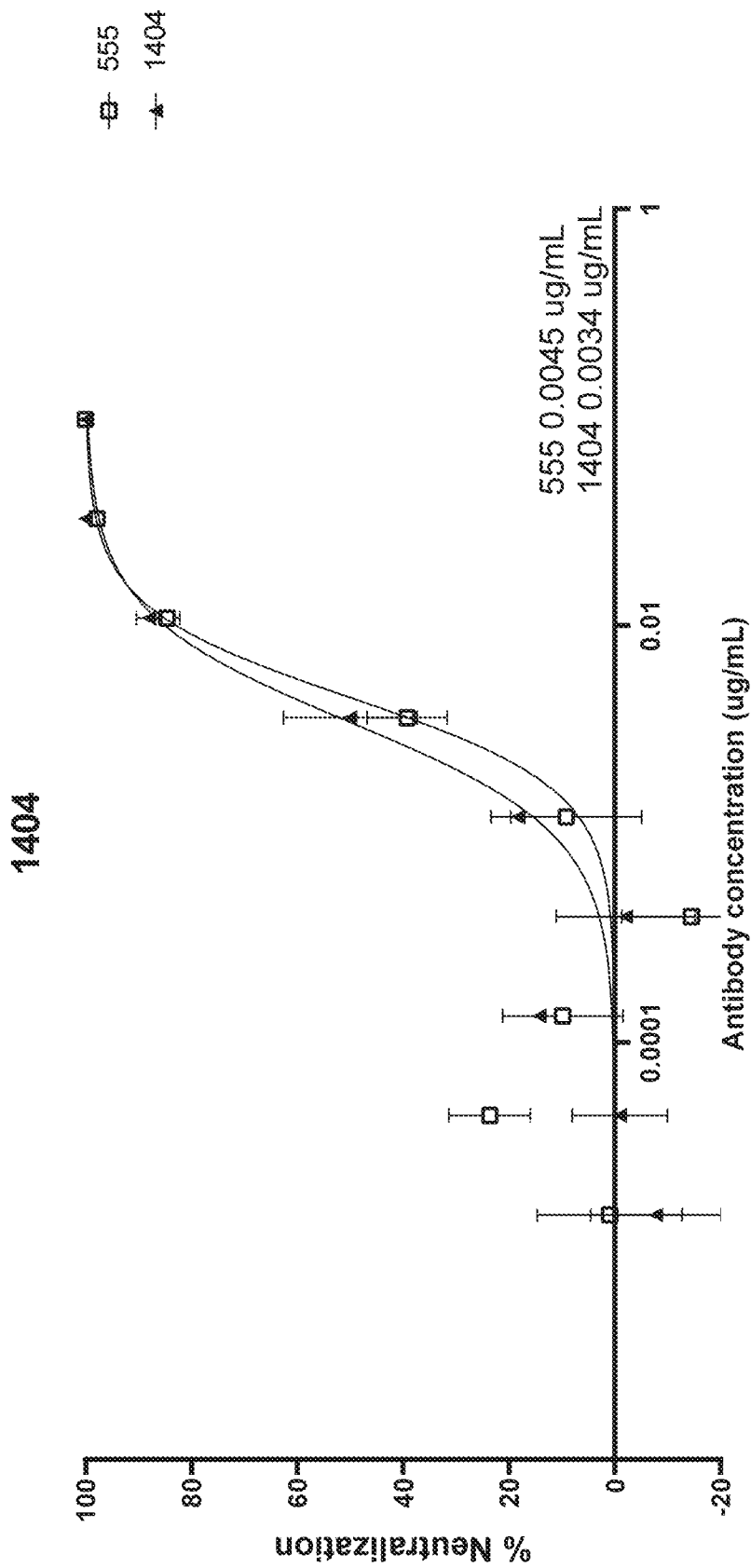
FIG. 11 is a line graph showing the results of a series of plaque reduction neutralization tests demonstrating the ability of mAbs 555 and 1404 to neutralize SARS-CoV-2 (hCoV-19/Canada/ON_ON-VIDO-01-2/202) in Vero 76/E6 cells. The $IC_{50}$ of each antibody is provided in the lower right corner above the X-axis.

Curves for mAbs 555 and 1404 are shown in FIG. 11. The IC$_{50}$ of each antibody is provided in the lower right corner above the X-axis.

Example 16

Immunofluorescence Assays

All work with authentic SARS-CoV-2 was completed in BSL-3 laboratories at USAMRIID in accordance with federal and institutional biosafety standards and regulations. Vero 76/E6 cells were inoculated with SARS-CoV-2 (GenBank MT020880.1) at a MOI=0.01 and incubated at 37° C. with 5% $CO_2$ and 80% humidity. At 50 h post-infection, cells were frozen at −80° C. for 1 h, allowed to thaw at room temperature, and supernatants were collected and clarified by centrifugation at ~2,500×g for 10 min.

A pre-titrated amount of authentic SARS-CoV-2/MT020880.1, at final multiplicity of infection of 0.2, was incubated with serial dilutions of monoclonal antibodies for 1 h at 37° C. The antibody-virus mixture was applied to monolayers of Vero-E6 cells in a 96-well plate and incubated for 1 hour at 37° C. in a humidified incubator. Infection media was then removed and cells were washed once with 1×PBS, followed by addition of fresh cell culture media. Culture media was removed 24 hours post infection and cells were washed once with 1×PBS. PBS was removed and plates were submerged in formalin fixing solution, then permeabilized with 0.2% Triton-X for 10 minutes at room temperature and treated with blocking solution. Infected cells were detected using a primary detection antibody recognizing SARS-CoV-2 nucleocapsid protein (Sino Biological) following staining with secondary detection antibody (goat a rabbit) conjugated to AlexaFluor 488. Infected cells were enumerated using Operetta high content imaging instrument and data analysis was performed using the Harmony software (Perkin Elmer). Results are shown in Table 16-1.

TABLE 16-1

IC$_{50}$ values for select anti-coronavirus antibodies

| Antibody ID | IC$_{50}$ (ng/mL) |
|---|---|
| 555 | 49.23 |
| 851 | 207.55 |
| 894 | 58.65 |
| 896 | 154.80 |
| 923 | 120.75 |
| 970 | 3670.00 |
| 1015 | 260.00 |
| 1037 | 32.80 |
| 1075 | 89.60 |
| 1404 | 22.10 |
| 1444 | 231.70 |
| 1495 | 134.25 |
| 1538 | 311.50 |

Figure 12:
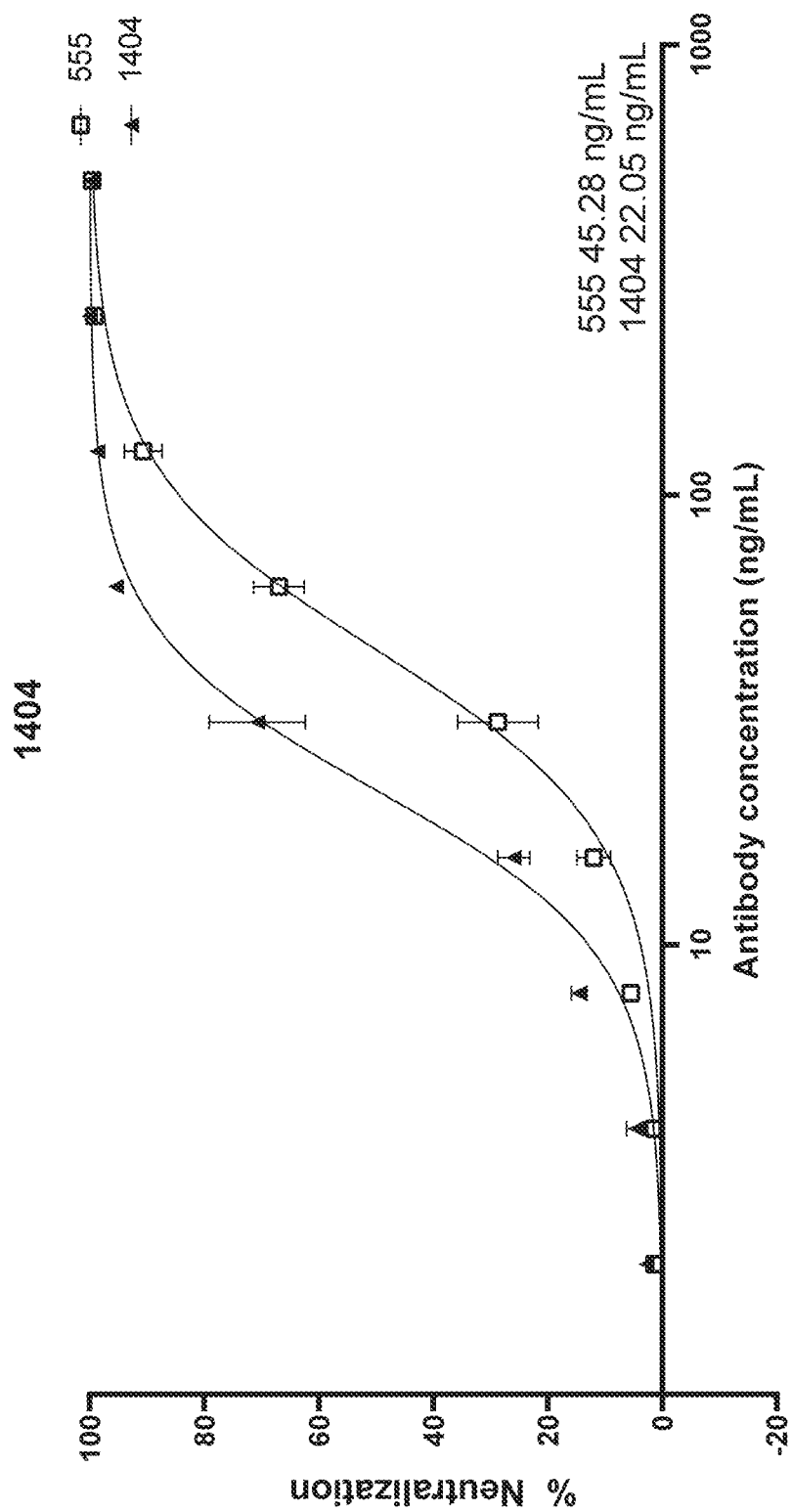
FIG. 12 is a line graph showing the results of a series of immunofluorescence assays demonstrating the ability of mAbs 555 and 1404 to neutralize SARS-CoV-2 (MT020880.1) in Vero 76/E6 cells. The $IC_{50}$ of each antibody is provided in the lower right corner above the X-axis.

Curves for mAbs 555 and 1404 are shown in FIG. 12. The IC$_{50}$ of each antibody is provided in the lower right corner above the X-axis.

Example 17

Surface Plasmon Resonance (SPR) Experiments

Surface plasmon resonance (SPR) capture experiments were performed on a BIACORE® 8K instrument equipped with a CM5 chip type (Cytiva, USA). The instrument uses one microfluidic module, a 8 multi-flow channel, to deliver samples to the chip surface via a unidirectional flow of sample at a set flow rate and concentration. The chip contains 8 flow cells, i.e., up to 8 ligands can be captured and analyzed at the same time.

The capture molecule, STREP-TACTIN® XT, was immobilized on a BIACORE® CM5 chip by direct coupling. The chip surface was first activated by flowing a freshly prepared 1:1 activation mix of 100 mM S-NHS, 400 mM EDC for 10 min at a flow rate of 10 µL/min. STREP-TACTIN® XT was diluted to 50 µg/mL in 10 mM Sodium Acetate buffer, then injected using all 8 channels, at a flow rate of 10 µL/min for 10 min. The chip was washed with HBS-EP+ (10 mM HEPES, 150 mM NaCl, 3 mM EDTA and 0.05% v/v Surfactant P20) for 1 min, at a flow rate of 30 µL/min. Finally, excess reactive esters were quenched by flowing 1 M ethanolamine for 10 min at a flow rate of 10 µL/min, followed by 3 conditioning steps of 30 s each, in 10 mM NaOH buffer, at a flow rate of 10 µL/min.

Combo binding assay of the antibodies was performed using the CM5 chip prepared as above on the BIACORE® instrument as described herein.

The antigen of interest displaying a Strep tag was diluted to 5 nM in HBS-EP+ buffer (as above), then flowed over the STREP-TACTIN® XT coated CM5 chip for 30 sec at a flow rate of 10 µL/min. The chip was washed with HBS-EP+ for 30 sec at a flow rate of 10 µL/min. The mAbs of interest were diluted to 200 nM in HBS-EP+ buffer. For each combo, combo binding was assessed by injecting the two mAbs (mAbs A and B) sequentially for 2 min each, at a flow rate of 10 µL/min. For each combo, controls were run with only one antibody present (antibody A-only and antibody B-only). 8 combos were tested simultaneously using the 8 channels, forming one cycle. One regeneration step of 60 s was performed between each cycle by injecting 3M GuHCl on the chip surface at a flow rate of 30 µL/min.

The data were analyzed using the BIACORE® Insight Evaluation Software. For each combination, the binding signal for antibody B was normalized to the binding signal for the antibody B-only control, such that the antibody B-only signal average is equivalent to one. A threshold of 0.8 was used to classify antibodies into 2 categories i.e., blockers (for antibodies with a signal under the threshold) and non-blockers (for antibodies with a signal over the threshold). Results are shown in Table 17-1. Anti-SARS-CoV-2 antibodies 555, 894, 1037, 1075, 1404 and 1495 are described herein. CB6 (etesevimab) is an anti-SARS-CoV-2 antibody described previously. VIR 5309 is an anti-SARS-CoV-2 antibody from Vir Biotechnology. 4A8 is an anti-SARS-CoV-2 antibody described, e.g., in Chi et al., "A neutralizing human antibody binds to the N-terminal domain of the Spike protein of SARS-CoV-2." *Science*. 7 Aug. 2020: 650-655. Opti373 (373(H24/L2)) is an affinity matured antibody obtained from Eli Lilly.

TABLE 17-1

| Antibody ID | 555 | 894 | 1037 | 1075 | 1130 | 1404 | 1495 | CB6 | VIRS309 | 4A8 | Opti373 |
|---|---|---|---|---|---|---|---|---|---|---|---|
| | | | | | BIACORE® Results | | | | | | |
| 555 | C | NC | NC | NC | | NC | NC | C | NC | | |
| 894 | NC | | | | | | | NC | NC | | |
| 1037 | NC | | | | | | | NC | NC | | NC |
| 1075 | NC | | | | | | | NC | NC | | |
| 1404 | NC | | | | | | | | NC | | NC |
| 1495 | NC | NC | NC | NC | NC | | C | NC | NC | NC | NC |

While this invention has been disclosed with reference to particular embodiments, it is apparent that other embodiments and variations of the inventions disclosed herein can be devised by others skilled in the art without departing from the true spirit and scope thereof. The appended claims include all such embodiments and equivalent variations.

SEQUENCE LISTING (5782 sequences)

SEQ ID NO: 1 - DNA, 345 bp, Homo sapiens
caggtgcagctgcaggagtcgggcccaggactggtgaagccttcggagaccctgtccctcacctgcactgtctctggtggctccatcagtagttactactggagctggatccggcagcccgccgggaagggactggagtggattgggcgtatctataccagtgggagcaccaactacaacccctccctcaagagtcgagtcaccatgtcagtagacacgtccaagaaccagttctccctgaagctgagctctgtgaccgccgcggacacggccgtgtattactgtgcggcaggctatggttcgattgactactggggccagggaaccctggtcaccgtctcctca

SEQ ID NO: 2 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcggacttttggccaggggaccaagctggagatcaaa

SEQ ID NO: 3 - DNA, 384 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagatcttttaagctggaagctatattgtagtggtggtagctgccctcagatggacgtctggggccaagggaccacggtcaccgtctcctca

SEQ ID NO: 4 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcagacttttggccaggggaccaagctggagatcaaa

SEQ ID NO: 5 - DNA, 369 bp, Homo sapiens
gaagtgcagctggtggagtctgggggaggcttggtacagcctggcaggtccctgagactctcctgtgcagcctctggattcacctttgattattatgccatgcactgggtccggcaagctccagggaagggcctggagtgggtctcaggtattagttggaatagtggtaccataggctatgcggactctgtgaagggccgattcaccatctccagagacaacgccaagaactccctgtatctgcaaatgaacagtctgagagctgaggacacggccttgtattactgtgcaaaagatagtcgaccatcggggcggtactactacggtatggacgtctggggccaagggaccacggtcaccgtctcctca

SEQ ID NO: 6 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgctcactttcggcggagggaccaaggtggagatcaaa

SEQ ID NO: 7 - DNA, 402 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatgaggcgtattacgatattttgactggttacatcaacgcaccgaaaaactactactactacggtatggacgtctggggccaagggaccacggtcaccgtctcctca

SEQ ID NO: 8 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctttcactttcggccctgggaccaaagtggatatcaaa

SEQ ID NO: 9 - DNA, 381 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagacgggggggaattactatggttcggggagttagactactacggtatggacgtctggggccaagggaccacggtcaccgtctcctca

SEQ ID NO: 10 - DNA, 321 bp, Homo sapiens
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatcggggggtgttcggcggagggaccaagctgaccgtccta

SEQ ID NO: 11 - DNA, 372 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgacgacacggccgtgtattactgtacaacagacctggcctttacgatttttggaggccgacgggggttcgacccctggggccagggaaccctggtcaccgtctcctca

SEQ ID NO: 12 - DNA, 315 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacgacttcggccaagggacacgactggagattaaa

SEQ ID NO: 13 - DNA, 360 bp, Homo sapiens
caggtgcatcttgtggagtctgggggaggcgtggtccagcctgggaggtccctgagactctcctgtgcagcctctggatttaccctcactagctatgctatgcactgggtccgccaggctccaggcaaggggctggagtgggtggctcttatatcatatgatgggagtgtcaaaaagtacgcagagtccgtgaagggccgaatcaccgtctccggagacaactccaggaacacgctgcatctgcaaattaacaccctcagagccgacgacacggctgtctattactgtgtgaggggcggtgtcagtggcccaaattcatttgatctctggggccaagggacaatggtcaccgtctcttca

SEQ ID NO: 14 - DNA, 336 bp, Homo sapiens
gatgttgtgatgactcagtctccactctccctgcccgtcacccttggacagccggcctccatctcctgcaggtctagtcaaagcctcgaatacagtgatggaaacacctacgtgaattggtttcagcagaggccaggccaatctccaaggcgcctaatttatcaggtttctaaccgggcctctggggtcccagacagattcagcggcagtgggtcaggcactgatttcacactgcaaatcagcagggtggaggctgaggatgttggcatttattactgcatgcaagggacacactggccggtgacgttcggccaggggaccaaggtggaaatcaaa

SEQ ID NO: 15 - DNA, 354 bp, Homo sapiens
gaggtccagttggtgcagtctggggctgaggtgaagaagcctggggctacagtgaaagtctcctgcaagttttctggagacaccttcagccactactacatacactgggtgcaacaggcccctggaaaagggcttgagtggatgggacttgtcgatcctcaagatggtgaatcagaatatgcacaaaagttccagggcaaagtcaccataaccgcggacacgtctatagacacatcctacttggaagtgaccagcctgagatttgacgacacggccttctatttctgcgcaacgcgggggatgagtggtgcttttgatcggtggggccaggggacactggtcaccgtctcttca

SEQ ID NO: 16 - DNA, 354 bp, Homo sapiens
gacatcgtgatgacccagtctccagactccctggctgtgtctctgggcgagagggccaccatcaactgcaagtccagccagagtattttatccacctccaacaataagaactacttagcttggtatcagcagaaaccaggacagcctcctaagttgctcatttactgggcatctacccgggaatccggggtccctgaccgattcagtggcggcgggtctgggacagatttcactctcaccatcagcagcctgcaggctgaagatgtggcagtttattactgtcagcaatattatcgtaccgcttatactactcccatatacacctttggccaggggaccaagctggagatcaaa

SEQ ID NO: 17 - DNA, 360 bp, Homo sapiens
caggtgcagctggtggagtctgggggaggcgtggtccagcctgggaggtccctgagactctcctgtgcagcctctggttttaacctcagcaactatgctatgcactgggtccgccagccatcaggcaaggggctggagtgggtgtcacttatatcatatgatggaagtattaaatattacacagactccgtgaagggccgattcaccgtctccggggacaattccaagaacacactgtttctgcaaatgaacagcctgcgacctgacgactcggctctttattactgtgtgaggggcggtgtcagtggcccaaattcttttgatatgtggggccaagggacaacggtcaccgtctcttcg

SEQ ID NO: 18 - DNA, 336 bp, Homo sapiens
gatgttgtgatgactcagtctccactctccctgcccgtcacccttggacagccggcctccatctcttgcaggtctagtcaaagcctcgtatacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttggggtttattactgcatgcaaggtacacactggccggtgacgttcggccaagggaccaaggtggaaatcaaa

SEQ ID NO: 19 - DNA, 348 bp, Homo sapiens
gaggtccacctggtacagtctggggctgagatgaagaagcctggggctacagtgaaaatctcctgcaaggtttctggaaacaccttcatcgatcactacattcaatgggtgcaacaggcccccggaaaagggtttgagtggatgggacttgttgatcctgaagatggtgaaacaatttacgcagagaagttccagggcagagtcaccataaccgcggacacgtctagagacacagcctacatggagctgagcagcctgaaatctgaagacacggccgtatattactgtggaacgcacggtgactaccttgactactggggccagggaaccctggtcaccgtctcctca

SEQ ID NO: 20 - DNA, 318 bp, Homo sapiens
ttctatgagctgacacagccatcctcagtgtcagtgtctccgggacagacagccttgattacctgctcaggagatgtagtggcaaaaaaatatgctcggtggtttcagcagaaggcaggccaggcccctgtattggtgatttataaagacactgagcggccctcagggatccctgagcgaatctccggctccagctcagggaccacagtcaccttgaccatcagcggggcccaggttgaggatgaggctgactattattgttactctgcgactgacaacaatctggtgttcggcggagggaccaaggtgaccgtctta

SEQ ID NO: 21 - DNA, 366 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagggagctcgtaggaggtttattgggaactattgactactggggccagggaaccctggtcaccgtctcctca

SEQ ID NO: 22 - DNA, 321 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacccgtacacttttggccaggggaccaagctggagatcaaa

SEQ ID NO: 23 - DNA, 393 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggaatatctattatagtgggagcacctactacaacccgtccctcaagagtcgagtcaccatatccgtagacacgtccaagaaccagttctccctgaagctgagctctgtgaccgccgcagacacggctgtgtattactgtgcgggagaagagctggatatagtggctacgatttactcctcccgctactactactacggtatggacgtctggggccaagggaccacggtcaccgtctcctca

SEQ ID NO: 24 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcaccagcactctggtattcggcggagggaccaagctgaccgtccta

SEQ ID NO: 25 - DNA, 369 bp, Homo sapiens
caggtgcagctggtgcagtctggggctgaggtgaagaggcctgggacctcagtgaaggtctcctgcaagacttctggatacaccttcaccgaccactttatccactgggtgcgacaggcccctggacgaaggcttgagtggatgggatggatcaaccctaacagtggtggcacaaactatgcacagaattttcagggcagggtcaccatgaccagggacacgtcaatcaccacagcctacatggacctgaccaggctaacttctgacgacacggccatctattattgtgcgcgagaggcggcctatggttcggggaatttgaactggttcgacccctggggccagggaacccgtgtcaccgtctcctcc

SEQ ID NO: 26 - DNA, 330 bp, Homo sapiens
aattttatgctgactcagccccactctgtgtcggagtctccggggaagacggtaaccatctcctgcaccggcagcagtggcagcattgccgccaactatgtgcactggtaccagcagcgcccgggcagtgccccccgcactgtaatctatgaggacaaccaaagaccctctggggtccctgatcggttctctggctccatcgacagctcctccaactctgcctccctcaccatctctggactgaagactgaggacgaggctgactactactgtcagtcttatgatggcgactcctgggtgttcggcggagggaccaaactgaccgtccta

SEQ ID NO: 27 - DNA, 372 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaggggtgggatgatagtagtggttattactattcctttgactactggggccagggaaccctggtcaccgtctcctca

SEQ ID NO: 28 - DNA, 330 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgaagctcactttcggcggagggaccaaggtggagatcaaa

SEQ ID NO: 29 - DNA, 378 bp, Homo sapiens
caggtgcagctggtgcagtctggggctgaggtgaagaagcctggggcctcagtgaaggtttcctgcaaggcctctggatataccttcaccacctactatatgcactgggtgcgacaggcccctggacaagggcttgagtggatgggaataatcaaccctagtggtggtagcgcaagctacgcacagaagttccagggcagagtcaccatgaccagggacacgtccacgagcacagtctacatggagctgagcagcctgagatctgaggacacggccgtgtattactgtgcgagagaccacaccctggtcaacggtgactacgaatactactacggtatggacgtctggggccaagggaccacggtcaccgtctcctca

SEQ ID NO: 30 - DNA, 324 bp, Homo sapiens
tcctatgagctgacacagccaccctcggtgtcagtgtccccaggacagacggccaggatcacctgctctggagatgcattgccaaaacaatatgcttattggtaccagcagaagccaggccaggcccctgtgtcggtgatatataaagacagtgagaggccctcagggatccctgagcgaatctctggctccagctcagggacaacagtcacgttgaccatcagtggagtccaggcagaagacgaggctgactattactgtcaatcagcagacagcagtggtacttatctagtattcggcggagggaccaagctgaccgtccta

SEQ ID NO: 31 - DNA, 381 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcccccggatactatgatagtagtgccccccagcccatcaactggttcgacccctggggccagggaaccctggtcaccgtctcctca

SEQ ID NO: 32 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcactttggtattcggcggagggaccaagctgaccgtccta

SEQ ID NO: 33 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattcggagagtgatagcagtggctggctacactactttgactactggggccagggaaccctggtcaccgtctcctca

SEQ ID NO: 34 - DNA, 315 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcaccgtggtattcggcggagggaccaagctgaccgtccta

SEQ ID NO: 35 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagccaggggggggagttatcgtaatgcttttgatatctggggccaagggacaatggtcaccgtctcttca

SEQ ID NO: 36 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacggtacacttttggccaggggaccaagctggagatcaaa

SEQ ID NO: 37 - DNA, 363 bp, Homo sapiens
caggtgcagctgcaggagtcgggcccaggactggtgaagccttcacagaccctgtccctcacctgcactgtctctggtgactccatcagcagtggtggttactactggagctggatccgccagcacccagggaagggcctggagtggattgggtacatctattacagtgggagcgcctactacaacccgtccctcaagagtcgagttaccatatcactagacacgtctaagaaccagttctccctgaagctgagctctgtgactgccgcggacacggccgtgtattactgtgcgagagattcagtggctggtttttcaatatttgactactggggccagggaaccctggtcaccgtctcctca

SEQ ID NO: 38 - DNA, 324 bp, Homo sapiens
tcgtctgagctgactcaggaccctgctgtgtctgtggccttgggacagacagtcaggatcacatgccaaggagacagcctcagaagctattatgcaagctggtaccagcagaagccaggacaggcccctgtacgtgtcatctatggtaaaaacaaccggccctcagggatcccagaccgattctctggctccagctcaggaaacacagcttccttgaccatcactggggctcaggcggaagatgaggctgactattactgtaactcctgggacagcagtggtaaccatgtggtattcggcggagggaccaagctgaccgtccta

SEQ ID NO: 39 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaatacatactacgcagactccgtgaagggccgattcaccatctccagagacaattccaagaacacgctgtatctgcaaatgaacagcctgagagctgaggacacggctgtgtattactgtgcgaggccgtatagtgggagctattttaactggttcgacccctggggccagggaaccctggtcaccgtctcctca

SEQ ID NO: 40 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcacttactgggcatctacccgggagtccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaa

SEQ ID NO: 41 - DNA, 405 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatcactccaatgccgacccgtattacgatttttggagtggttattatacaaggacgtactactacggtatggacgtctggggccaagggaccacggtcaccgtctcctca

SEQ ID NO: 42 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgcactttcggccctgggaccaaagtggatatcaaa

SEQ ID NO: 43 - DNA, 372 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtagtggtggtaacacatactacgcagactccgtgaagggccggttcaccatctccagagacaattccaagaacacgctgtatctgcaaatgaacagcctgagagccgaggacacggccgtatattactgtgcgaaagatttattccagggactctactatggttcaggggagtttgactactggggccagggaaccctggtcaccgtctcctca

SEQ ID NO: 44 - DNA, 330 bp, Homo sapiens
cagtctgccctgactcagcctgcctccgtgtctgggtctcctggacagtcgatcaccatctcctgcactggaaccagcagtgacgttggtgcttataactatgtctcctggtaccaacaacacccaggcaaagcccccaaactcatgatttatggtgtcagtaatcggccctcaggggtttctaatcgcttctctggctccaagtctggcaacacggcctccctgaccatctctgggctccaggctgaggacgaggctgattattactgcagctcatatacaagcagcagcactcgggtcttcggaactgggaccaaggtcaccgtccta

SEQ ID NO: 45 - DNA, 372 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagatcagaagtgggagctactccactactactacggtatggacgtctggggccaagggaccacggtcaccgtctcctca

SEQ ID NO: 46 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 47 - DNA, 384 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaagaaccgcgtcgaagatgattacatttgggggagttatcgttggaactactttgactactggggccagggaaccctggtcaccgtctcctca

SEQ ID NO: 48 - DNA, 333 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacccatgtggtattcggcggagggaccaagctgaccgtccta

SEQ ID NO: 49 - DNA, 363 bp, Homo sapiens
gaggtgcagctggtggagtctgggggaggcttggtgcagcctggggggtccctgagactctcctgtgcagcctctggattcaccttcagtggacatagcatgaactgggtccgccagtctccagggacggggctggagtgggtttcatacattactgttagtagtagtaccatatactacgcagactctgtgaagggccgattcaccatctccagagacaatgccaagagttcactttttctgcaaatgaacagcctgagagacgaggacacggctgtgtattactgtgcgagagatggggcagctcgtccctactggtatttcgatctctggggccgtggcaccctggtcactgtctcctca

SEQ ID NO: 50 - DNA, 339 bp, Homo sapiens
gacatcgtgatgacccagtctccagactccctggctgtgtctctgggcgagagggccaccatcaactgcaagtccagccagagtgttttatacacctccaacaataagaactacttagcttggtaccagcacaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatgccactccattcgctttcggccctgggaccaaagtggatatcaaa

SEQ ID NO: 51 - DNA, 357 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgctgatggggtatagggcagtggctggatatgactactggggccagggaaccctggtcaccgtctcctca

SEQ ID NO: 52 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 53 - DNA, 369 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacgcacatccgggtatagcagcagctggcctagctttgactactggggccagggaaccctggtcaccgtctcctca

SEQ ID NO: 54 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacagtggacgttcggccaagggaccaaggtggaaatcaaa

SEQ ID NO: 55 - DNA, 378 bp, Homo sapiens
caggtgcaactgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaactccaagaaccagttctccctgaagctgagctctgtgaccgccgcggacacggccgtatattactgtgcgagagagagtgtagcagcagctggtatttcgtactactactacggtatggacgtctggggccaagggaccacggtcaccgtctcctca

SEQ ID NO: 56 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtacacttttggccaggggaccaagctggagatcaaa

SEQ ID NO: 57 - DNA, 354 bp, Homo sapiens
caggtccacctggtggagtctgggggaggcgtggtccagcctgggaagtccctgagactctcctgtgcaggctcgggattcatcttcagtgactttggcatgcactgggtccgccagtctccaggcaaggggctggagtgggtggcagttgtgtcatatgatggaagtgtcacaaagtactcagactcctttgagggccgattcaccatctccagagacaattccaagaataccttgtatctgcaaatggatagcctgagacctgatgacacggctatttattactgtgcgaaaggccagggggcaaatcttcttcattattggggtaagggaatcctggtcaccgtctcgtca

SEQ ID NO: 58 - DNA, 336 bp, Homo sapiens
gatgttgtgctgactcagtctccactctccctgcccgtcacccttggacagccggcctccatctcctgcaggtctagtgaaagcctcgtttacactgatggagacacctacttacattggtttcaccagaggccaggccaatctccaaggcgcctaatttataaggtttctaatcgggactctggggtcccagacagattcagcggcagtgggtcaggcactgatttcacactgaaaatcagcagggtggaggctgaggatgttggggtttattactgcatgcaaggtacacactggccattcactttcggccctgggaccaaagtggatatcaaa

SEQ ID NO: 59 - DNA, 369 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatcttttatagtgggagcacctactacaacccgtccctcaagagtcgagtcaccatattcgtagacacgtccaagaaccagttctccctgaagctgagctctgtgaccgccgcagacacggctgtgtattactgtgcgagattcgattaccaagtagtggacttaacggggtttgactactggggccagggaaccctggtcaccgtctcctca

SEQ ID NO: 60 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcaggagcctgcagcctgaagattttgcaacttattactgtctacagtataatagttacccgctcactttcggcggagggaccaaggtggagatcaaa

SEQ ID NO: 61 - DNA, 390 bp, Homo sapiens
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcccgaggcgcaaaccgggattacgatattttgactggttactactcatactactactacggtatggacgtctggggccaagggaccacggtcaccgtctcctca

SEQ ID NO: 62 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatccgtggacgttcggccaagggaccaaggtggaaatcaaa

SEQ ID NO: 63 - DNA, 378 bp, Homo sapiens
caggtgcagctggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaccccaacgtatgcccagggcttcacaggacggtttgtcttctccttggacacctctgtcagcacggcatatctgcagatcagcagcctaaaggctgacgacactgccgtgtattactgtgcgagagatctgtatagcagcagccaagagaattattacaactactacatggacgtctggggcaaagggaccacggtcaccgtctcctca

SEQ ID NO: 64 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatctatgctgcatccagtttgcaaagtggggtcccatcaaggttcagtggcagtggatctgggacagctttcactctcaccatcagcagtctgcaacctgaagattttgtaatttactactgtcaacagagtttcagtaccccgtacacttttggccaggggaccaagctggagatcaaa

SEQ ID NO: 65 - DNA, 375 bp, Homo sapiens
caggttcacttggtgcaatctggagctgaggtgaagaagcctggggcctcagtgaaggtctcctgcgcggcttctggttacacctttaataattatggtgtcagctgggtgcgacaggcccctggacaagggcttgagtggatgggatggatcagcgcttccaatggtaacacaaagtatgcacagaacctccagggcagagtcaccatgaccacagacacatccacgagcacagcctacatggagctgaggagcctgagatctgacgacacggccgtgtattactgtgcgagagatctggtgggacctaccgcccctaactactactacggtatggacgtctggggccaagggaccgcggtcaccgtctcctca

SEQ ID NO: 66 - DNA, 333 bp, Homo sapiens
cagtctgtgctgacgcagccgccctcagtgtctggggccccagggcagagggtcaccatctcctgcactgggagcagctccagcatcggggcaggttatgatgttcactggtaccagcaacttccaggaacagcccccaaactcctcatctatgctaacagcaatcggccctcaggggtccctgaccgactctctggctccaagtctggcacctcagcctccctggccatcactgggctccaggctgaggatgaggctgattattactgccagtcctatgacagcagcctgagtggttatgtcttcggaaccgggaccaaggtcaccgtccta

SEQ ID NO: 67 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcctcgggggggagctactttggcggtatggacgtctggggccaagggaccacggtcaccgtctcctca

SEQ ID NO: 68 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccctttatgtcttcggaactgggaccaaggtcaccgtccta

SEQ ID NO: 69 - DNA, 348 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatcttcaagggggaggtggcccctggggccagggaaccctggtcaccgtctcctca

SEQ ID NO: 70 - DNA, 321 bp, Homo sapiens
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcgaacgttcggccaagggaccaaggtggaaatcaaa

SEQ ID NO: 71 - DNA, 354 bp, Homo sapiens
caggtgcagctgcaggagtcgggcccaggactggtgaagccttcggggaccctgtccctcacctgtgttgtctctggtgtctccatcagcagtagtaactggtggagttgggtccgccagcccccagggaaggggctggagtggattggagaaatttattatagtgggaccaccaattataacccgtccctcaagagtcgagtcaccatatcagttgacaagtccaagaatcagttctccctgaagttgaactctgtgaccgacgcggacacggccgtgtattactgtgcgagaaagtgggaacttctagcttttgatatctggggccaagggacaatggtcaccgtctcttca

SEQ ID NO: 72 - DNA, 336 bp, Homo sapiens
gatattgtgatgactcagtctccactctccctgcccgtcacccctggagagccggcctccatctcctgcaggtctcgtcagagcctcctgcatcgtaatggatacaactctttggattggtacctacagaagccagggcagtctccacaactcctgatctatttgggttctaatcgggcctccggggtccctgacaggttcagtggcagtggatcaggcacagattttacattgaaaatcagcagagtggaggctgaggatgttggggtttattactgcatgcaagctctacaaactccgtacacttttggccaggggaccaagctggagatcaaa

SEQ ID NO: 73 - DNA, 351 bp, Homo sapiens
gaggtgcagctggtggagtctgggggaggcttggtccagcctggggggtccctgagactctcctgtgcagcctctggattcaccgtcagtagcaactacatgaactgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagatctgggaccttcgggtatggacgtctggggccaagggaccacggtcaccgtctcctca

SEQ ID NO: 74 - DNA, 318 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttcccccttttcggcggagggaccaaggtggagatcaaa

SEQ ID NO: 75 - DNA, 372 bp, Homo sapiens
caggtgcagctgcaggagtcgggcccaggactggtgaagccttcacagaccctgtccctcacctgcactgtctctggtggctccatcagcagtagtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagagtcgtaggatattgtagtagtaccagctgctatgttgactactggggccagggaaccctggtcaccgtctcctca

SEQ ID NO: 76 - DNA, 327 bp, Homo sapiens
gaaattgtgttgacacagtctccagccaccctgtctttgtctccaggggaaagagtcaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggggctcactttcggcggagggaccaaggtggagatcaaa

SEQ ID NO: 77 - DNA, 357 bp, Homo sapiens
gaggtgcagctggtggagtctgggggaggcttggtccagcctggggggtccctgagactctcctgtgcaggctctggattcactcttagtaactattggatgacatgggtccgccaggctccagggaaggggctggagtgggtggccaacataaaccaagatgcaagtaggaaatactatggtgactctgtgaagggccgattcagcgtctccagagacaacgccaagaactccctgtatctgcaaatgaacagcctgacagccgaggacacgggtttttactactgtgtgagagaggaactaccttctactccgggatcgacctggggccagggaaccctggtcaccgtctcctca

SEQ ID NO: 78 - DNA, 330 bp, Homo sapiens
cagtctgccctgactcagcctgcctccgtgtctgggtctcctggacagtcgatcaccatctcctgcactggaaccagcagtgacattggtggttataaccatgtctcctggtaccaacaacacccaggcaaagcccccaaacttatgatttatggtgtcagtaatcggccctcaggggtttctgatcgcttctctggctccaagtctgacaatacggcctccctgaccatctctgggctccaggctgaggacgaggctgattactactgcagctcacctacaagccgcggaaacaaggtcttcggaactgggaccaaggtcaccgtcctc

SEQ ID NO: 79 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagatccttccgcggtggctactactacggtatggacgtctggggccaagggaccacggtcaccgtctcctca

SEQ ID NO: 80 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccccctattcactttcggccctgggaccaaagtggatatcaaa

SEQ ID NO: 81 - DNA, 366 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagaagaaggggagtgggaaaaagactactacggtatggacgtctggggccaagggaccacggtcaccgtctcctca

SEQ ID NO: 82 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatcgggtattcggcggagggaccaagctgaccgtccta

SEQ ID NO: 83 - DNA, 375 bp, Homo sapiens
caggtgcagctggtgcagtctgggactgaggtgaagaagcctggggcctcagtgaaggtctcctgcaaggcttctggatacaccttcaccggctactatatgcactgggtgcgacaggcccctggacaagggcttgagtggatgggatggatcaaccctatcagtggtggcacaaactatgcacagaagtttcagggcagagtcaccatgaccagggacacgtccatcagcacagcctacatggagttgagcaggctgagatctgacgacacggccgtgtattactgtgcgagagagggagccgggtatagcagcagctggtactactacggtatggacgtctggggccgagggaccacggtcaccgtctcctca

SEQ ID NO: 84 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccttggacgttcggccaagggaccaaggtggaaatcaaa

SEQ ID NO: 85 - DNA, 363 bp, Homo sapiens
caggtacagctggtggagtctgggggaggcgtggtccagcctgggaggtccctgacactctcctgtgcagcctctggattcaccttcagtagctatgctatgcactgggtccgccaggctccaggcaaggggctggagtgggtggcacttatctcatatgatggaaataataaatactacgcagactccgtgaagggccgattcaccttctccagagacaattccaagaacacgctgtatctgcaaatgaacagcctgagagctgaggacacggctgtgtattactgtgcgaggactaatagtgggagctatcgaacggcctttgactactggggccagggaaccctagtcaccgtctcctca

SEQ ID NO: 86 - DNA, 318 bp, Homo sapiens
gacatccagatgacccagtctccttccaccctgtctgcatctgtaggagacagagtcaccatcacttgccgggccagtcagagtattagtatctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagtttgtggacgttcggccaagggaccaaggtggaaatcaaa

SEQ ID NO: 87 - DNA, 372 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcattttgtggtggtgattgctaccctcccgatgctttagatatctggggccaagggacaatggtcaccgtctcttca

SEQ ID NO: 88 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccgctcactttcggcggagggaccaaggtggagatcaaa

SEQ ID NO: 89 - DNA, 384 bp, Homo sapiens
caggtccagctggtacagtctggggctgaggtgaggaagcctggggcctcagtgaaggtctcctgcaaggtttccggttacaccctcagtgaattatccatgcactgggtgcgacaggctcctggaaaagggcttgagtggatgggaggttttgatcctgaagatggtgaaagaatgtacgcacagaagttccagggcagagtcaccatgaccgaggacacatccacagacacagcctacatggaactgagcagcctgagatctgaggacacggccatctattactgtacaacagatctttcctatctgtggtcgggcaaactggaacctgactactggtacttcgctctctggggccgtggcaccctggtcactgtctcctca

SEQ ID NO: 90 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacaggctcctaagttgctcatttcctgggcatctacccgggaatccggggtccctgaccgattcagtggcagcgggtctgggacagaattcactctcaccatcagcagcctgcaggctgaagatgtggcagtttactactgtcagcaatattatggtactcctctgacttttggccaggggaccaagctggagatcaga

SEQ ID NO: 91 - DNA, 360 bp, Homo sapiens
caggtgcagctggtggagtctgggggaggcgtggtccagcctgggaggtccctgagactctcctgtgcagcctctggttttaacctcagcagctatgctatgcactgggtccgccaggcatcaggcaaggggctggagtgggtgtcacttatatcatatgatggaagtattaaatattacgcagactccgtgaagggccgattcaccgtctccggagacaattccaagaacatgctgtttctgcaaatgaacagcctgagagctgacgactcggctctttattactgtgtgaggggcggtgtcagtggcccaaatgcttttgatatctggggccaagggacaacggtcaccgtctcttcg

SEQ ID NO: 92 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacgtgaattggtttcagcagaggccaggccaatctccaaggcgcctaatctataaggtttctaaccgggactctggggtcccagacagattcagcggcagtgggtcaggcactgatttcgcactgaaaatcagcagggtggaggctgaggatgttggggtttattactgcatgcaaggtacacactggccggtgacgttcggccaagggaccaaggtggaaatcaaa

SEQ ID NO: 93 - DNA, 345 bp, Homo sapiens
gaggtgcagctgttggagtctgggggaggcttggtacagcctggggggtccctgagactctcctgtgcagcctctggattcacctttagcacctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgctagtggctactctccagactactggggccagggaaccctggtcaccgtctcctca

SEQ ID NO: 94 - DNA, 321 bp, Homo sapiens; identical to SEQ ID NO: 70

SEQ ID NO: 95 - DNA, 393 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagagcagacctcttatgattacgtttgggggactttaggggcctactactactacggtatggacgtctggggccaagggaccacggtcaccgtctcctca

SEQ ID NO: 96 - DNA, 324 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatctggtgttcggcggagggaccaaactgaccgtccta

SEQ ID NO: 97 - DNA, 375 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaaagatggaggttattgtggtggtgactgctattccgacggggttgactactggggccagggaaccctggtcaccgtctcctca

SEQ ID NO: 98 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtggtattcggcggagggaccaagctgaccgtccta

SEQ ID NO: 99 - DNA, 366 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaaaggatacacctgggattactactactacggtatggacgtctggggccaagggaccacggtcaccgtctcctca

SEQ ID NO: 100 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaccccgtggacgttcggccaagggaccaaggtggaaatcaaa

SEQ ID NO: 101 - DNA, 387 bp, Homo sapiens
cagctgcagctgcaggagtcgggcccaggactggtgaagccttcggagaccctgtccctcacctgcagtgtctctggtggctccatcagcagtagtagttaccactggggctggatccgccagcccccagggaagggactggagtggattgggagtatctattatagtgggagcacctactacaacccgtccctcaagagtcgagtcaccatatcagtagacacgtccaagaaccagttctccctgaagctgaggtctgtgaccgccgcggacacggccgtgtattactgtgcgggcctccgagttgtgattacatttgggggagttatcccaaagggaggagcttttgatatctggggccaagggacaatggtcaccgtctcttca

SEQ ID NO: 102 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtccta

SEQ ID NO: 103 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaggccgtatagtgggagctaccagagctactttgactactggggccagggaaccctggtcaccgtctcctca

SEQ ID NO: 104 - DNA, 324 bp, Homo sapiens
gaaattgtgatgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccctcactttcggcggagggaccaaggtggagatcaaa

SEQ ID NO: 105 - DNA, 357 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagtaggtagcagcagctggtactttgactactggggccagggaaccctggtcaccgtctcctca

SEQ ID NO: 106 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagataacaagcggccctcagggatccctgagcgattctctggctccaactctgggaacacagccactctgaccatcagcgggacccaggctatggatgaggctgactattactgtcaggcgtgggacagcagcactggggtattcggcggagggaccaagctgaccgtccta

SEQ ID NO: 107 - DNA, 372 bp, Homo sapiens
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagaagagactctgggcagcagctggtatgaaagctatattgactactggggccagggaaccctggtcaccgtctcctca

SEQ ID NO: 108 - DNA, 327 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccgcgggtattcggcggagggaccaagctgaccgtccta

SEQ ID NO: 109 - DNA, 378 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgaggatgttgatagcagcagctggtactagcagggactactacggtatggacgtctggggccaagggaccacggtcaccgtctcctca

SEQ ID NO: 110 - DNA, 324 bp, Homo sapiens; identical to SEQ ID NO: 98

SEQ ID NO: 111 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggcctgggtgggagctactactctctttttgactactggggccagggaaccctggtcaccgtctcctca

SEQ ID NO: 112 - DNA, 333 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcctgtggtattcggcggagggaccaagctgaccgtccta

SEQ ID NO: 113 - DNA, 390 bp, Homo sapiens
gaggtgcagctggtggagtctgggggaggcctggtcaagcctggggggtccctgagactctcctgtgcagcctctggattcaccctcagtagttatagcatgaactgggtccgccaggctccagggaaggggctggagtgggtctcatgcattagtagtagtagtagttacatatactacgcagactcagtgaagggccgattcaccatctccagagacaacgccaagaactcactgtatctgcaaatgaacagcctgagagccgaggacacggctgtgtattactgtgcgagcgatcccctagatattgtagtagtaccagctgctagggattactactactacggtatggacgtctggggccaagggaccacggtcaccgtctcctca

SEQ ID NO: 114 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactttttatgtcttcggaactgggaccaaggtcaccgtccta

SEQ ID NO: 115 - DNA, 366 bp, Homo sapiens
caggtgcagctggtgcaatctgggtctgagttgaagaagcctggggcctcagtgaagctttcctgccaggcttctgggtacagcttcactaaccatgcaatgaattgggtgcgccaggcccctggacaggggcttgagtggatgggatggatcaacaccaacactgggaacccaacatatgcccagggcttcacaggacggtttgtcttctctttggacacctctgtcagcacgacatatctgcacatcagcagcctaaaggctgaggacactgccgtatattactgtgcgagagcgtctgcgcgtccgggtgttgcaacaaacttagacttctggggccagggaaccctggtcgtcgtctcctca

SEQ ID NO: 116 - DNA, 321 bp, Homo sapiens
gacatccagatgacccagtctccatcctccctgtctgcatctgtaggagacagagtcaccatcacttgccgggcaagtcagaatattgacaactatttaaattggtatcagcagaaaccagggaaagcccctaagctcctgatctatgctgcatccagattgcatagtggggtcccatcaaggttcagtggcagtggatctgggacagattttactctcatcatcagcagtctacaacctgaagatcttgcaacttattactgtcaacagagttacagtaatcctctcactttcggccctgggaccaaagtggatatcaga

SEQ ID NO: 117 - DNA, 360 bp, Homo sapiens
caggtgcatcttgtggagtctgggggaggcgtggtccagcctgggaggtccctgagactctcctgtgcagcctctggatttactctcactgcctatgctatgcactgggtccgccaggccccaggcaagaggctggagtgggtggctctgatatcatatgatgggagtgtcaaaaagtacgcagactccgtgaagggccgaatcaccgtctccggagacacctccacgaacacgctgcatctgcaaatgaacagcctcagagccgacgacacggctgtctattactgtgtgaggggcggtgtcagtggcccaaattcatttgatctctggggccaagggaccatggtcaccgtctcttca

SEQ ID NO: 118 - DNA, 336 bp, Homo sapiens
gatgttgtgatgactcagtctccactctccctgcccgtcacccttggacagccggcctccatgtcctgcaggtctagtcaaagcctcgaatacagtgatggaaacacctacgtgaattggtttcaccagaggccaggccaatctccaaggcgcctaatttataaggtttcttaccgggactctggggtcccagacagattcagcggcagtgggtcaggcactgatttcacactgcaaatcagcagggtggaggctgaggatgttggcatctattactgcatgcaaggtacacactggccggtgacgttcggccaggggaccaaggtggaaatcaaa

SEQ ID NO: 119 - DNA, 381 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcctcctcaccggcagcagctggtacaagtcagtactactactactacggtatggacgtctggggccaagggaccacggtcaccgtctcctca

SEQ ID NO: 120 - DNA, 336 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttccgtacacttttggccaggggaccaagctggagatcaaa

SEQ ID NO: 121 - DNA, 372 bp, Homo sapiens
caggtgcaattggtggagtctgggggaggcgtggtcccgcctgggaggtcgctgagcctcccctgtgcagcctctggattcagcttcagtgcctatgctatgcactggctccgccaggctccaggcaaggggctagagtgggtggctgttatctcatacgatggaactgttaaatacgtcgcagactccgtgaggggccgattcaccatctccagagacaattccaacaacactctgtatctgcaaatgaccagcctgagatccgatgacacggctgtctattactgtgcgagagacttaggggcgttagcagcagctccgactgtatacttcgttcactggggccagggcaccctggtcaccgtctcctca

SEQ ID NO: 122 - DNA, 324 bp, Homo sapiens
tcttatgtgctgactcagccaccgtcagtgtcagtggccccaggaaagacggccaccattacctgtgcgggagaagacattggaaggaaaagtgtgcactggtaccagcagaagccaggccaggcccctgtcctggtcatcttttattatagcgaccggccctcagggatacctgaccgattctctggctccgtttctgggaacacggccaccctgaccatcggcagggtcgaagccggggatgaggccgactatttttgtcaggtgtgggataggactactaatcatgtgatattcggcggggggaccaaggtgaccgtccta

SEQ ID NO: 123 - DNA, 360 bp, Homo sapiens
caggtgcagctggtggagtctgggggaggcgtggtccagcctgggaggtccctgagactctcgtgtgcagcctctggttttaacctcagcaactatgctatgcactgggtccgccaggcatcaggcaaggggctggagtgggtgtcacttatatcatatgatggaagtattaaatattacacagactccgtgaagggccgattcaccgtctccggggacaattccaagaacacactgtttctgcaaatgaacagcctgcgacctgacgactcggctctttattactgtgtgaggggcggtgtcagtggcccaaattcttttgatatgtggggccaagggacaacggtcaccgtctcttcg

SEQ ID NO: 124 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttggggtttattattgcatgcaaggtacacactggccggtgacgttcggccaagggaccaaggtggaaatcaaa

SEQ ID NO: 125 - DNA, 381 bp, Homo sapiens
caggttcagctggtgcagtctggagctgaggtgaagaagcctggggcctcagtgaaggtctcctgtaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgaggacagcctacatggagctgaggagcctgagatctgacgacacggccgtgtattattgtgcgagagtagggtgttactatgatagtagtggttattcgtgcgctgaaaacttccagcactggggccagggcaccctggtcaccgtctcctca

SEQ ID NO: 126 - DNA, 330 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgctctattcggcggagggaccaagctgaccgtccta

SEQ ID NO: 127 - DNA, 372 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagaaattaccccacgatttttggagtggaaagccccattcgacccctggggccagggaaccctggtcaccgtctcctca

SEQ ID NO: 128 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctagcacttttggccaggggaccaaactggagatcaaa

SEQ ID NO: 129 - DNA, 357 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagacgaagacgtagcagcagctcttgactactggggccagggaaccctggtcaccgtctcctca

SEQ ID NO: 130 - DNA, 330 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatccggagagggtattcggcggagggaccaagctgaccgtccta

SEQ ID NO: 131 - DNA, 363 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaagtacgatttttgccccggggggctggttcgacccctggggccagggaaccctggtcaccgtctcctca

SEQ ID NO: 132 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtacccattatgtcttcggaactgggaccaaggtcaccgtccta

SEQ ID NO: 133 - DNA, 378 bp, Homo sapiens; identical to SEQ ID NO: 55

SEQ ID NO: 134 - DNA, 324 bp, Homo sapiens
gaaattgtgttgacgcagtctccaggcaccctgtctttgtctccaggggaaagagccaccctctcctgcagggccagtcagagtgttagcggcaggtacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcaacactatggtagctcaccagggaccttcggccaagggacacgactggagattaaa

SEQ ID NO: 135 - DNA, 363 bp, Homo sapiens
caggtgcagctgcaggagtcgggcccaggactggtgaagccttcacagaccctgtccctcacctgcactgtctctggtggctccatcagcggtggtggttactactggagctggatccgccagcacccagggaagggcctggagtggattgggtacatctattacagtgggagcacctactacaacccgtccctccagagtcgagttaccatatcagtagacacgtctaagaaccagttctccctgaagctgagctctgtgactgccgcggacacggccgtgtattactgtgcgagagtggggactagcagtgtctggtactttgactactggggccagggaaccctggtcaccgtctcctca

SEQ ID NO: 136 - DNA, 324 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcactaagcggccctcaggggtccctgatcgcttctctggctccaagtctggcaacacggcctccctgaccatctctgggctccaggctgaggatgaggctgattattactgctcctcatatgcaggcagctgggtattcggcggagggaccaagctgaccgtccta

SEQ ID NO: 137 - DNA, 363 bp, Homo sapiens
cagatcaccttgaaggagtctggtcctacgctggtgaaacccacacagaccctcacgctgacctgcacgttctctggcttctcactcaacactagtggagtgggtgtgggctggatccgtcagcccccaggaaaggccctggagtggctttcactcattttttggaatgatgataagcgctacagcccatctctgaggagcaggctcaccatcaccaaggacacctccaaaaaccaggtggtccttacaatgaccaacatggaccctgtggacacagccacatacttctgtgcacacaggaacagtggctggtctctcaagtttgactcctggggccagggatccctggtcaccgtctccgca

SEQ ID NO: 138 - DNA, 321 bp, Homo sapiens
gacatccagatgacccagtctccatcttccgtgtctgcatctgtaggagacagagtcaccatcacttgtcgggcgaggcagggtattagcagctggttggtctggtatcagcagaaaccaggcaaagcccctaagctcctgatctttggtgcatccagtttgcaaagtggggtcccatcaaggttcaacgccagtggaactgggacagaattcactctcaccatcagcagcctgcagcctgaagattttgcaacttactattgtcaacaggctgacagtttccccatcaccttcggccaagggacacgactggagattaaa

SEQ ID NO: 139 - DNA, 360 bp, Homo sapiens
caggtgcagctggtggagtctgggggaggcgtggtccagcctgggaggtccctgagactctcgtgtgcagcctctggttttaacctcagcaactatgctatgcactgggtccgccaggcatcaggcaaggggctggagtgggtgtcacttatatcatacgatggaagtattaaatattacacagactccgtgaagggccgattcaccgtctccggggacaattccaagaacacactgtttctgcaaatgaacagcctgcgacctgacgactcggctctttattactgtgtgaggggcggtgtcagtggcccaaattcttttgatatgtggggccaagggacaacggtcaccgtctcttcg

SEQ ID NO: 140 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttgggatttattattgcatgcaaggtacacactggccggtgacgttcggccaagggaccaaggtggaaatcaaa

SEQ ID NO: 141 - DNA, 378 bp, Homo sapiens; identical to SEQ ID NO: 55

SEQ ID NO: 142 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacagtcagcggcctgcagcctgaagattttgcaacttattactgtctacagtataatagttccccgctcactttcggcggagggaccaaggtggagatcaaa

SEQ ID NO: 143 - DNA, 360 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagagggtatagtggctacgattacgcttgactactggggccagggaaccctggtcaccgtctcctca

SEQ ID NO: 144 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgttggtcatttatgaagataccaagcggccctcagggatccctgagcgattctctggctccaactctgggaacacagccactctgaccatcagcgggacccaggctatggatgaggctgactattactgtcaggcgtgggacagcagcactgcatgtgtcttcggaactgggaccaaggtcaccgtccta

SEQ ID NO: 145 - DNA, 402 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattttcagtattacgatttttggagtggttatttaacggtttcctccccgacgagctactacggtatggacgtctggggccaagggaccacggtcaccgtctcctca

SEQ ID NO: 146 - DNA, 330 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtggtattcggcggagggaccaagctgaccgtccta

SEQ ID NO: 147 - DNA, 354 bp, Homo sapiens
cagatcaccttgaaggagtctggtccaacgctggtgaaacccacagagaccctcacgctgacctgcagcttctctggcttctcactcactaagactggagaggctgcgggctggatccgtcaggccccaggaagggccctggagtgggtcacagtcattttttgggatgatgataagcgatacagcccatctcttcagaacagaatcagtgtcaccaaggacacctccaaaaatcaggtggtccttagaatgaccaacgtggcccgtttcgatacaggcacatatttctgttgggccatggggggacctggtaaagaatattttggccagggaaccctggtcgccgtctcctca

SEQ ID NO: 148 - DNA, 336 bp, Homo sapiens
cagtctgtgctgacccagccgccctcagtgtctggggccccggggcagagggtcaccatctcctgcactgggaccagttccagcatcgggccttattctgatgtgcactggtatcaacacgtttccggaaaagcccccaggctcctcatctttggaaacagcaatcggccctcaggggtccctgaccgattctctggctccaagtctggcacctcagcgtccctggtcatcgctgggctccaggctgaggatgaggctgattattactgccagtcttatgacagcagtctgggtgaaatttatgtcttcggaactgggaccacggtcaccgtccta

SEQ ID NO: 149 - DNA, 372 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggatacacgacgatattttgactggttatcattatgttgactactggggccagggaaccctggtcaccgtctcctca

SEQ ID NO: 150 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctgggacgttcggccaagggaccaaggtggaaatcaaa

SEQ ID NO: 151 - DNA, 351 bp, Homo sapiens
caggttcatctggtggaatctgggggaggcgtggtcctgcctgggaggtccctgagactctcctgttcagcctctcaattcatcttcagtaactatgacatgcactgggtccgccagtctcccggcatggggctggagtgggtggcaggtatttcatctgatggatctgataaatactacatagactccgtcaggggccgatttaccatctccagagacaatgccaagaacacgctgtttttgcaaatgaacagcctgacaactgaggacacggctgtctattcctgtgcgaaaggtggtggtaaattcggccaatattggggccgggggaccctggtcaccgtctcctca

SEQ ID NO: 152 - DNA, 321 bp, Homo sapiens
gccatccagatgacccagtctccatcctccctgtctgcttctgtaggagacagagtcaccatcacttgccgggcgagtcaggtcattagaaatgatttagcctggtttcagcagaaaccaggggaagcccctaatctcctggtctattctgcatccaatttacaaagtggagtcccatcgaggttcagcggcagtggatctggcacagatttcactctcaccatcagcagcctgcagcctgaagattttgcaacttattactgtctacaggattacagttacccctacacttttggccaggggaccaagctggacatgaaa

SEQ ID NO: 153 - DNA, 360 bp, Homo sapiens
caggtgcagttggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatattacgcagactccgtgaagggccgattcaccatctccagagacaattccaagaacacgctgtatctgcaaatgaacagaatgagagctgaggacacggctgtgttttactgtgcgagagatcccgtagcagtggctggcccgtttgactactggggccagggaaccctggtcaccgtctcctca

SEQ ID NO: 154 - DNA, 318 bp, Homo sapiens
tcctatgagctgactcagccaccctcagtgtccgtgtccccaggacagacagccagcatcacctgctctggagataaattgggggataaatatgcttactggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 155 - DNA, 378 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgacccatacgtattactttgattcggggagttacaattacgaggaggttgactactggggccagggaaccctggtcaccgtctcctca

SEQ ID NO: 156 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgtggacgttcggccaagggaccaaggtggaaatcaaa

SEQ ID NO: 157 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagctcaaaccgattactatgatagtagtggatggtttgactactggggccagggaaccctggtcaccgtctcctca

SEQ ID NO: 158 - DNA, 327 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtactccccattgggtgttcggcggagggaccaagctgaccgtccta

SEQ ID NO: 159 - DNA, 384 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcaattatatggtatgatggaagtaataaatactatgcagactccgtgaagggccgattcaccatctccagagacaattccaagaacacgctgtatctgcaaatgaacagcctgagagccgaggacacggctgtgtattactgtgcgaaagataccgggggatattgtagtggtggtagctgctacccggaatcctactttgactactggggccagggaaccctggtcaccgtctcctca

SEQ ID NO: 160 - DNA, 327 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcaacagggtcgaagccggggatgaggccgactattactgtcaggtgtgggatggtagtagtgatcatctttatgtcttcggaactgggaccaaggtcaccgtccta

SEQ ID NO: 161 - DNA, 369 bp, Homo sapiens
caggtgcagctgcaggagtcgggcccaggactggtgaagccttcggagaccctgtccctcacctgcgctgtctctggttactccatcagcagtgattattactggggctggatccggcagcccccagggaaggggctggagtggattgggagtatctatcatagtgggagcacctactacaacccgtccctcaagagtcgagtcaccatatcaatagacacgtccaagaaccagttctccctgaagctgagctctgtgaccgccgcagacacggccgtgtattactgtgcgagagatcctggaaattacgatattttgactggcatatttgactactggggccagggaaccctggtcaccgtctcctca

SEQ ID NO: 162 - DNA, 339 bp, Homo sapiens
cagtctgccctgactcagcctgcctccgtgtctgggtctcctggacagtcgatcaccatctcctgcactggaaccagcagtgacgttggtgtttataactatgtctcctggtaccaacaacacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactctcgcggtttatgtcttcggaactgggaccaaggtcaccgtccta

SEQ ID NO: 163 - DNA, 354 bp, Homo sapiens
cagatcaccttgaaggagtctggtccaacgctggtgaaacccacagagaccctcacgctgacctgcagcttctctggcttctctctcactagaactggagaggctgcgggctggatccgtcaggccccaggaagggccctggagtgggtcacagtcattttttgggatgatgataagcgatacagcccatctcttcagagcagactcaccgtcaccaaggacacctctaaaaatcaggtggtccttacaatgaccaacgtggcccgtttcgatacagccacatatttctgttgggccatggggggacctggtaaagaatattttggccagggaacccaggtcgccgtctcctca

SEQ ID NO: 164 - DNA, 336 bp, Homo sapiens; identical to SEQ ID NO: 148

SEQ ID NO: 165 - DNA, 378 bp, Homo sapiens
caggtgcagctggtgcagtctggggctgaagtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggccgatattgtactggtggtgtatgctggggggactggtacttcgatctctggggccgtggcaccctggtcactgtctcctca

SEQ ID NO: 166 - DNA, 333 bp, Homo sapiens
cagtctgtgctgacgcagccgccctcagtgtctggggccccagggcagagggtcaccatctcctgcactgggagcagctccaacatcggggcaggttatgatgtacattggtaccagcagcttccaggaacagcccccaaattcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggcccggtattcggcggagggaccaagctgaccgtccta

SEQ ID NO: 167 - DNA, 372 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacgtccattacgatattttgactggttaaccaactttgactactggggccagggaaccctggtcaccgtctcctca

SEQ ID NO: 168 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgatcaccttcggccaagggacacgactggagattaaa

SEQ ID NO: 169 - DNA, 390 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacaggaggtgtctcggtatggttcagggagttccccgcctcgtatagtgggagctacttgggctactggggccagggaaccctggtcaccgtctcctca

SEQ ID NO: 170 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 171 - DNA, 363 bp, Homo sapiens
caggtgcaactggtggagtctgggggagacgtggtccagcctgggacgtccctgagactctcctgtgcagcctctggcttcaccttcaataattacggtttccactgggtccgccaggctccaggcaaggggctggagtgggtggcacttatttcaagcgatggagccagtacacactacgcagactccgtgaagggccgattcaccatctccagagacagttccgtgaacaccctgtatctgcaaatgaacagcctgagccttgaggacacggctgtctattactgtgcgactggccattgtggtactacttgctattactttgactactggggccagggaaccctggtcagcgtctcctca

SEQ ID NO: 172 - DNA, 321 bp, Homo sapiens
gacatccaggtgacccagtctccatcctacctgtctgcatctgttggagacagagtaaccatcacttgccgggcaagtcagaccattagtacttttctacaatggtatcagcagaaagtggggaaagcccctaagctcctgatctatgctgcgtccactttgcaaagtggggtcccatcaaggttcagtggcagtggatctgggacagatttctctctcaccatcagtagtctgcaacctgaagattttgcaacttactactgtcaacagagttacagtgcccctctcagtttcggcggagggaccaaggtggagatcaaa

SEQ ID NO: 173 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtggatggcagttatatcatatgatggaagtaataaatactatgcagactccgtgaagggccgattcaccatctccagagacaattccaagaacacgctgtatctgcaaatgaacagcctgagagctgaggacacggctgtgtatttctgtgcgaaaggatatagtgggagctactatgaaccttttgactactggggccagggaaccctggtcaccgtctcctca

SEQ ID NO: 174 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgactttcggcggagggaccaaggtggagatcaaa

SEQ ID NO: 175 - DNA, 378 bp, Homo sapiens
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagagtggggatggtcgataactggaacttcgagggcaactggttcgacccctggggccagggaaccctggtcaccgtctcctca

SEQ ID NO: 176 - DNA, 324 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagcgtggtattcggcggagggaccaagctgaccgtccta

SEQ ID NO: 177 - DNA, 372 bp, Homo sapiens
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatggcccccaagacgggtatagcagcagctggtaccttgactactggggccagggaaccctggtcaccgtctcctca

SEQ ID NO: 178 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctgacacttttggccaggggaccaagctggagatcaaa

SEQ ID NO: 179 - DNA, 375 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtgtcacaaactatgcacagaagtttcagggcagggtcaccatgaccagggacacgtccatcagcacagcctacatggagctgagcaggctgagatctgacgacacggccgtgtattactgtgcgagagaggcgtattactatatttcggggagttatgggaattggttcgacccctggggccagggaaccctggtcaccgtctcctca

SEQ ID NO: 180 - DNA, 330 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcccttgtacacttttggccaggggaccaagctggagatcaaa

SEQ ID NO: 181 - DNA, 375 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagagaccatgagctaccaaataccagcagctggttcgggcactttgagtactggggccagggaaccctggtcaccgtctcctca

SEQ ID NO: 182 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtactggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttccgtggtattcggcggagggaccaagctgaccgtccta

SEQ ID NO: 183 - DNA, 396 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagagaataaagttccgaccattatagcagcagctggtacaagggactactactactacggtatggacgtctggggccaagggaccacggtcaccgtctcctca

SEQ ID NO: 184 - DNA, 342 bp, Homo sapiens
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccggcgtacacttttggccaggggaccaagctggagatcaaa

SEQ ID NO: 185 - DNA, 366 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcccccccttatagccctccctcctcctggttcgacccctggggccagggaaccctggtcaccgtctcctca

SEQ ID NO: 186 - DNA, 333 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcgtcttatgtcttcggaactgggaccaaggtcaccgtccta

SEQ ID NO: 187 - DNA, 378 bp, Homo sapiens
cacgtgcagctggtggagtctgggggaggcgtggtccagcctgggaggtccctgagactctcctgtgcagcgtctggattcatctccaggaattatggcatggagtgggtccgccaggctccaggccaggggctggagtgggtggcaggtatatggtatgatggaagtaaaaaatattatgcagactccgtgaagggccgattcactatctccagagacacttccaagaacacgctgtttctgcaaatggacagcctgagagccgaggacacggctgtcttttactgtgcgaccgcgacgaaaacattttgtggtggtgactgtccccctgggggtatggacgtctggggccaagggaccacggtcaccgtctccaca

SEQ ID NO: 188 - DNA, 324 bp, Homo sapiens
tcctatgtgctgactcagccaccctcagtgtcagtggccccgggaaagacggcctggattacctgtgtgggaaacaacattgaaagtgaaagtgtgcactggtaccagcagaggccaggccaggcccctgtgctggtcatctattatgatagcgaccggccctcagggatccctgagcgattctttggctccaactctgggaacacggccaccctgaccatcagcagggtcgaagccggggatgaggccgactattactgtcaggtgtgggatagtaattctgatcttatggtattcggcggagggaccaagctgaccgtccta

SEQ ID NO: 189 - DNA, 381 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagtgggggtagaggaggaggtagtggtggtagctgtcccttacggtatggacgtctggggccaagggaccacggtcaccgtctcctca

SEQ ID NO: 190 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgaggtattcggcggagggaccaagctgaccgtccta

SEQ ID NO: 191 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggcctcgttcggggagttattacgcctactttgactactggggccagggaaccctggtcaccgtctcctca

SEQ ID NO: 192 - DNA, 321 bp, Homo sapiens
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttaccctcccactttcggcggagggaccaaggtggagatcaaa

SEQ ID NO: 193 - DNA, 381 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatcgcccttattactatggttcgggaatccccggctactacggtatggacgtctggggccaagggaccacggtcaccgtctcctca

SEQ ID NO: 194 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacctcgtacacttttggccaggggaccaagctggagatcaaa

SEQ ID NO: 195 - DNA, 369 bp, Homo sapiens
caggtgcacctggtggagtctgggggaggcgtggtccagcctgggaggtccctgagactctcctgtgcagcctctggattcaccttcagtagctttcctatgcactgggtccgccaggctccaggcaaggggctggagtgggtggcagttatatcatatgatggaggcgatgaacactacacagactccgtggagggccgattcaccatctccagagacaattccctgaacacactgtatctgcaaatgagcagcctgagacttgaggacacggctgtctattactgtgcgcgagatcggtatgatagtagtggttattactacgtctctgactactggggccagggaaccctgatcaccgtctcctca

SEQ ID NO: 196 - DNA, 327 bp, Homo sapiens
tcctatgagctgacacagccaccctcggtgtcagtgtccccaggacagacggccaggatcagctgctctggagatgcattgccaaagcaatatgcttattggtaccagcagaagccaggccaagcccctgtgttggtgatatataaagacagtgagaggccctcagggatccctgagcgattctctggctccagctcagggacaacagtcacgttgaccatcagtggagtccaggcagaagacgaggctgactactactgtcaatcagcagacagcaggggtactgatccctgggtgttcggcggggggaccaagctgaccgtccta

SEQ ID NO: 197 - DNA, 369 bp, Homo sapiens
caggttcagttggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttaccatggtaacacaaactatgcacagaagctccagggcagagtcaccatgaccacagacacatccacgagcacagcctacatggagctgaggagcctgagatctgacgacacggccgtgtattactgtgcgagagtgggtttatggtggctgggccatgccgatgcttttgatatctggggccaagggacaatggtcaccgtctcttca

SEQ ID NO: 198 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcttactttcggcggagggaccaaggtggagatcaaa

SEQ ID NO: 199 - DNA, 369 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagagggccgatagcagtggctggtataggcccctggttcgacccctggggccagggaaccctggtcaccgtctcctca

SEQ ID NO: 200 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccaagctgaccgtccta

SEQ ID NO: 201 - DNA, 360 bp, Homo sapiens
caggtgcagctggtggagtctgggggaggcgtggtccagcctgggaggtccctgagactctcctgtgcagcctctggttttaacctcaacagctatgctatgcactgggtccgccaggcatcaggcaaggggctggagtgggtgtcacttatgtcatatgatggaagtattaaatattacgcagactccgtgaagggccgattcaccgtctccggagacaattccaggaacacactgtttctgcaaatgaacagcctgagacctgacgactcggctctttattactgtgtgaggggcggtgtcagtggcccaaattcttttgatctctggggccaagggacaacggtcaccgtctcttcg

SEQ ID NO: 202 - DNA, 336 bp, Homo sapiens
gatgttgtgatgactcagtctccactctccctgcccgtcacccttggacagccggcctccatctcctgcaggtctagtcaaagcctcgtatacagtgatggaagcacctacgtgaattggtttcagcagaggccaggccaatctccaaggcgcctaatctataaggtttctaaccgggactctggggtcccagacagattcagcggcagtgggtcaggcactgatttcgcactgaaaatcagcagggtggaggctgaggatgttggggtttattactgcatgcaaggtacacactggccggtgacgttcggccaagggaccaaggtggaaatcaaa

SEQ ID NO: 203 - DNA, 354 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgtacagtgggaactactggtacttcgatctctggggccgtggcaccctggtcactgtctcctca

SEQ ID NO: 204 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctttattcactttcggccctgggaccaaagtggatatcaaa

SEQ ID NO: 205 - DNA, 366 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaggcaaaaatagtgggagctacttttttgcttttgatatctggggccaagggacaatggtcaccgtctcttca

SEQ ID NO: 206 - DNA, 336 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtacgtacacttttggccaggggaccaagctggagatcaaa

SEQ ID NO: 207 - DNA, 378 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgaccactatggttcggggagttattcgtttagatcactacggtatggacgtctggggccaagggaccacggtcaccgtctcctca

SEQ ID NO: 208 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcttctcttcggaactgggaccaaggtcaccgtccta

SEQ ID NO: 209 - DNA, 360 bp, Homo sapiens
caggtgcagctggtggagtctgggggaggcgtggtccagcctgggaggtccctgagactctcctgtgcagcctctggttttaacctcagcaactatgctatgcactgggtccgccaggcatcaggcaaggggctggagtgggtgtcacttatatcatatgatggaagtgttaaatattacacagactccgtgaagggccgattcaccgtctccggggacaattccaagaacacactgtttctgcaaatgaacagcctgcgacctgacgactcggctctttattactgtgtgaggggcggtgtcagtggcccaaattcttttgatatgtggggccaagggactacggtcaccgtctcttcg

SEQ ID NO: 210 - DNA, 336 bp, Homo sapiens
gatgttgtgatgactcagtctccactctccctgcccgtcacccttggacagccggccaccatctcctgcaggtctagtcaaagcctcgtatacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttggagtttattactgcatgcaaggtacacactggccggtgacgttcggccaagggaccaaggtggaaatcaaa

SEQ ID NO: 211 - DNA, 345 bp, Homo sapiens; identical to SEQ ID NO: 93

SEQ ID NO: 212 - DNA, 324 bp, Homo sapiens
gaaatagagatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtacacttttggccaggggaccaagctggagatcaaa

SEQ ID NO: 213 - DNA, 393 bp, Homo sapiens
gaggtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattcggtatcgattatgattacatttgggggagttatcgttatacaaccttatttgactactggggccagggaaccctggtcaccgtctcctca

SEQ ID NO: 214 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcgtacacttttggccaggggaccaagctggagatcaaa

SEQ ID NO: 215 - DNA, 360 bp, Homo sapiens
caggtgcagctggtggagtctgggggaggcgtggtccagcctgggaggtccctgagactctcctgtgcagcctctggttttaacctcagcagctatgctatgcactgggtccgccaggcatcaggcaaggggctggagtgggtgtcacttatatcatatgatggaagtattaaatattacacagactccgtgaagggccgattcaccgtctccggagacaattccaagaacacgctgtttctgcaaatgaacagcctgcgacctgacgactcggctctttattactgtgtgaggggcggtgtcagtggcccaaattcttttgatatgtggggccaagggacaacggtcaccgtctcttcg

SEQ ID NO: 216 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacgtgaattggtttcagcagaggccaggccaatctccaaggcgcctaatctataaggtttctatccgggcctctggggtcccagacagattcagcggcagtgggtcaggcactgatttcgcactgaaaatcagcagggtggaggctgaggatgttggggtttattactgcatgcaaggtacacactggccggtgacgttcggccaagggaccaaggtggaaatcaaa

SEQ ID NO: 217 - DNA, 357 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggggactagtggggtacaactggttcgacccctggggccagggaaccctggtcaccgtctcctca

SEQ ID NO: 218 - DNA, 315 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttcactttcggccctgggaccaaagtggatatcaaa

SEQ ID NO: 219 - DNA, 384 bp, Homo sapiens
caggtgcagctggtgcagtctggggctgaggtgaagaagcctggggcctcagtgaaggtctcctgcaaggcttctggatacaccttcaccggttattatatacactgggtgcgacaggcccctggacaagggcttgaatggatgggatggatcaaccctaacagtggtggcacaatctatgcacagaagtttcagggcagggtcaccatgaccagggacacgtccatcagcaccgcctacatggagctgagcaggctgacatctgacgacacggccgtttattcctgtgcgagagaaccttattacgatattttgactggttattatgcaccgagacgctactttgactattggggccagggaaccctggtcaccgtctcctca

SEQ ID NO: 220 - DNA, 330 bp, Homo sapiens
caatctgccctgactcagcctgcctccgtgtctgggtctcctggacagtcgatcaccatctcctgcactggaaccagcagtgacgttggtagttataactatgtctcctggtacctacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgatttttactgcagctcatatacaagcagaagcacttatgtcttcggaactgggaccaaggtcaccgtccta

SEQ ID NO: 221 - DNA, 354 bp, Homo sapiens
cagatcaccttgaaggagtctggtccaacgctggtgaaacccacagagaccctcactctgacctgcgccttctctggcttctctctcactaaaactggagaggccgcgggctggatccgtcaggccccaggaagggccctggagtgggtaacggtcattttttgggatgatgataagcggtacagtccatctctacagaatagactcaccgtcaccaaggacacctctaaaaacgtggtggtccttacaatgaccaacgtggaccctgtggatacagccacatatttctgttgggccatggggggacctggtaaagagttctttggccagggaacccgggtcgccgtctcctca

SEQ ID NO: 222 - DNA, 336 bp, Homo sapiens
cagtctgtgctgacccagccgccctcagtgtctggggccccggggcagagggtcaccgtctcctgcactgggaccagttccagcatcgggccttattctgatgtgcactggtatcagcacattccaggaaaagcccccaggctcctcatctttgggaccagcaatcggccctcaggggtccctgcccgattctctggctccaagtctggcagctcagcctccctggtcatcgctgggctccaggctgaggatgaggctgattattactgccaatcttatgacagcagtctgggtgagatttatgtcttcggaactgggaccacggtcaccgtccta

SEQ ID NO: 223 - DNA, 357 bp, Homo sapiens
caggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatatcatatgatggaagcaacaaatactacgcagactccgtgaagggccgattcaccatctccagagacaattccaagaacacgctgtatctgcaaatgaacagcctgagagctgaggacacggctgtgtattactgtgggagaggggggggtggctacgtttattttgactactggggccagggaaccctggtcaccgtctcctca

SEQ ID NO: 224 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatacaacagggccactggcatcccagacaggttcagtggcagtgggtctgggacagacttcactctcaccatcagcagactggagcctgaagattttgcagtgtattactgtcagcagtatggtagctcaccagggtacacttttggccaggggaccaagctggagatcaaa

SEQ ID NO: 225 - DNA, 372 bp, Homo sapiens
caggtgcaattggtggagtctgggggaggcgtggtcccgcctgggaggtcgctgagcctcccctgtgcagcctctggattcaccttcagtgcctatgctatgcactggctccgccaggctccaggcaaggggctagagtgggtggctgttatctcatacgatggaactgttaaatacgtcgcagactccgtgaggggccgattcaccatctccagagacaattccaacaacactctgtatctgcaaatgaccagcctgagatccgatgacacggctgtctattactgtgcgagagacttaggggcgttagcagcagctccgactgtatacttcgttcactggggccagggcaccctggtcaccgtctcctca

SEQ ID NO: 226 - DNA, 324 bp, Homo sapiens; identical to SEQ ID NO: 122

SEQ ID NO: 227 - DNA, 399 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaggagttctggtttcgggtagcaacaacgacctaggagacgattactactactactacggtatggacgtctggggccaagggaccacggtcaccgtctcctca

SEQ ID NO: 228 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattattgtcaatcagcagacagcagtggtacttatgtggtattcggcggagggaccaagctgaccgtccta

SEQ ID NO: 229 - DNA, 390 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatctaggtacctcggcattactatggttcggggagttatttttgaactacggtatggacgtctggggccaagggaccacggtcaccgtctcctca

SEQ ID NO: 230 - DNA, 330 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagccctatattggtattcggcggagggaccaagctgaccgtccta

SEQ ID NO: 231 - DNA, 375 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagggcccgactattacgatttttggagtggttatttctacggtatggacgtctggggccaagggaccacggtcaccgtctcctca

SEQ ID NO: 232 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactcactttcggcggagggaccaaggtggagatcaaa

SEQ ID NO: 233 - DNA, 357 bp, Homo sapiens
caggtgcagctgcaggagtcgggcccaggactggtgaagccttcggggaccctgtccctcacctgcgctgtctctggtggctccatcagcagtagtaaatggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaagggaattaggggaggggacctttacctactggggccagggaaccctggtcaccgtctcctca

SEQ ID NO: 234 - DNA, 327 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccctcgctcactttcggcggagggaccaaggtggagatcaaa

SEQ ID NO: 235 - DNA, 390 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagattccttattacgatttttggagtggccccagggggtgaattactactactacggtatggacgtctggggccaagggaccacggtcaccgtctcctca

SEQ ID NO: 236 - DNA, 324 bp, Homo sapiens
tcgtctgagctgactcaggaccctgctgtgtctgtggccttgggacagacagtcaggatcacatgccaaggagacagcctcagaagctattatgcaagctggtaccagcagaagccaggacaggcccctgtacgtgtcatctatggtaaaaacaaccggccctcagggatcccagaccgattctctggctccagctcaggaaacacagcttccttgaccatcactggggctcaggcggaagatgaggctgactattactgtaactcctgggacagcagtggtaaccatccgtgtatgggcggagggaccaagctgaccgtccta

SEQ ID NO: 237 - DNA, 378 bp, Homo sapiens
caggtgcagctgcaggagtcgggcccaggactggtgaagccttcggagaccctgtccctcacctgcactgtctctggtggctccatcaatagttacttctggagctggatccggcagcccgccgggaagggactggagtggattgggcgtatcttacccagtgggagcaccaactacaatccctccctcaagagtcgagtcaccatgtcagtagacacgtccaagaaccagttctccctgaaggtgagctctgtgaccgccgcggacacggccgtgtattactgcgcgagagatcagccgactacggtgactcgggggtactactactacaacggtatggacgtctggggccaagggaccacggtcaccgtctcctca

SEQ ID NO: 238 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctctgatgcatccaacagggccactggcatcccagccaggttcagtggcagtgggtctgggacagacttcactctcaccatcagcagcctagagcctgaagattttgcagtttattactgtcagcagcgtagcaactggcctatcaccttcggccaagggacacgactggagattaaa

SEQ ID NO: 239 - DNA, 372 bp, Homo sapiens
gaggtgcagctggtggagtctgggggaggcctggtcaagcctggggggtccctaagactctcctgtgcaacctctggattcaccttcaggacctatagcatgaactgggtccgccaggctccagggaaggggctggagtgggtctcatccattactactagtcgtaattacatatactatgcagactcagtgaggggccgattcaccatctccggagacaacgccaacaactcactgtatctgcaaatgaacagcctgagagccgaggacacggctgtttattattgtgcgagagttcggttcgtgcgggacacccgaaaaccctactactttgacttctggggccagggaaccctggtcaccgtctcctca

SEQ ID NO: 240 - DNA, 330 bp, Homo sapiens
cagtctgtgctgactcagccaccctcagcgtctgggacccccgggcagagggtcaccatttcttgttctggaagcacctccaacatcggaagtcttgctgtgaactggtaccagcagctcccaggaacggcccccaaactcctcatctataataataatcagcggccctcaggggtccctgaccgattctctggctccaagtctggcacctcagcctccctggccatcagtgggccccagtctgaggatgaggctgattattactgtgcagcatgggatgacagtttgaatggttgggtgttcggcggagggaccaaactgaccgtcctg

SEQ ID NO: 241 - DNA, 384 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagattcggggggcatggacgatttttggagtggttattatagtcccgggggtgactactggggccagggaaccctggtcaccgtctcctca

SEQ ID NO: 242 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttgggtattcggcggagggaccaagctgaccgtccta

SEQ ID NO: 243 - DNA, 381 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaggtcctttggatttttggagtggttattttaggctgcgctactttgactcctggggccagggaaccctggtcaccgtctcctca

SEQ ID NO: 244 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcacttgtgtcttcggaactgggaccaaggtcaccgtccta

SEQ ID NO: 245 - DNA, 372 bp, Homo sapiens
caggtgcaactggtggagtctgggggaggcgtggtccagcctgggaggtccctgagactctcctgtgcagcctctgggttcaccctcaagaactatggcatgcactgggtccgccaggctccaggcaaggggctggagtgggtgatagtgttatcatttgatggaagcgatgaatataaagctgactccgtgaggggccgattcaccgtctccagagacaattccaagaacacgctgtttctgcaaatgaacagcctgagacctgacgacacggctgtctattactgcgcgagagagcagcctactatgattgagggaggccgaggtccttttgatatatggggccaagggacaatggtcaccgtctcttca

SEQ ID NO: 246 - DNA, 324 bp, Homo sapiens
gaagtagtaatgacgcagtctccagccaccctgtctgtgtctcctggggacagagccaccctctcctgcagggccagtcagggtgttaatagcaacttagcctggtaccagcagaaacctggccaggctccccggctcctcatctatgctgcatccaccagggccaccggtatcccagccaggttcagtgccagtggctctgggacacacttcactctcaccatcagcagcctgcagtctgaagattttgcagtttattactgtctgcagtataacaactggcctccgtggactttcggccaggggaccaagctggagattaaa

SEQ ID NO: 247 - DNA, 393 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatcggcagtattacgatattttgactggttattaccttccaacgtccgaatactactttgactactggggccagggaaccctggtcaccgtctcctca

SEQ ID NO: 248 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgactttcggcggagggaccaaggtggagatcaaa

SEQ ID NO: 249 - DNA, 369 bp, Homo sapiens
caggtgcagctggtggagtctgggggaggcgtggtccagcctgggaggtccctgagactctcctgtgcggcctctggattcaccttcagtaactatggcatgcactgggtccgccaggctccaggcaaggggctggagtggatgacagttatatcttttgatggaagaaataaatattatgcagactccgtgaagggccgattcaccatctccagagacaattccaagaatacgctgtttctgcaaatgaacagcctgacaactgaggacacggctctgtatttctgtgcgagcggccgaaggccgcggtatagcagtggctggtcctttgactactggggccagggaaccctggtcaccgtctcctca

SEQ ID NO: 250 - DNA, 321 bp, Homo sapiens
gacatccagatgacccagtctccatcctccctgtctgcatctgtaggagacagagtcaccatcacttgccaggcgagtcaggacattggcaactatttaaattggtatcagcagaaactagggaaagcccctaacctcctgatctacgatgcatccaatttggaaacaggggtcccatcaagattcagtggaagtggatctgggacagattttactttcaccatcaacagcctgcagcctgaagatactgcaacatattactgtcaacagtatgatgatccctcgatcaccttcggccaagggacacgactggagattaaa

SEQ ID NO: 251 - DNA, 366 bp, Homo sapiens
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcaactattggtactgctggtgacacatactatccaggctccgtgaagggccgattcaccatctccagagaaaatgccaagaactccttgtatcttcaaatgaacagcctgagagccggggacacggctgtgtattactgtgcaagagtagcctatagcagcagcttcgtctactggtacttcgatctctggggccgtggcaccctggtcactgtctcctca

SEQ ID NO: 252 - DNA, 324 bp, Homo sapiens
gacatccagatgacccagtctccatcctccctgtctgcatctataggagacagagtcaccatcacttgccgggcaagtcagagcattagcagctatttaaattggtatcagcagaaaccagggaaagcccctaacctcctgatctatgctgcatccagtttgcaaagtggggtcccatcaaggttcagtggcagtggatctgggacagatttcactctcaccatcagcagtctgcaacctgaagattttgcaacttactactgtcaacagagttacactacccccctgtacacttttggccaggggaccaagctggagatcaaa

SEQ ID NO: 253 - DNA, 357 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattctccatctccagagacaattccaagaacacgctgtatctgcaaatgaacagcctgagagctgaggacacggctgtgtattactgtgcgagaagtagtggtggttattactactttgactactggggccagggaaccctggtcaccgtctcctca

SEQ ID NO: 254 - DNA, 312 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaactccgcactcactttcggcggagggaccaaggtggagatcaaa

SEQ ID NO: 255 - DNA, 363 bp, Homo sapiens
caggtgcagctggtggagtctgggggaggcgtggtccagcctgggaggtccctgagactctcctgtgcagcctctggattcaccttcagtagctatgctatacactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaccccggagtgggagctattggggggcttttgatatctggggccaagggacaatggtcaccgtctcttca

SEQ ID NO: 256 - DNA, 330 bp, Homo sapiens
cagtctgtgctgacgcagccgccctcagtgtctggggccccagggcagagggtcaccatctcctgcactgggagcagctccaacatcggggcacgttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgaggggggtattcggcggagggaccaagctgaccgtccta

SEQ ID NO: 257 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcgtatggggggagctacggggggtggttcgacccctggggccagggaaccctggtcaccgtctcctca

SEQ ID NO: 258 - DNA, 318 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggtggacgttcggccaagggaccaaggtggaaatcaaa

SEQ ID NO: 259 - DNA, 366 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagacgacacaaaaaactacggtgacttagacattgactactggggccagggaaccctggtcaccgtctcctca

SEQ ID NO: 260 - DNA, 321 bp, Homo sapiens
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaacaatctaggggtattcggcggagggaccaagctgaccgtccta

SEQ ID NO: 261 - DNA, 360 bp, Homo sapiens
caggtgcagctggtggagtctgggggaggcgtggtccagcctgggaggtccctgagactctcctgtgcagcctctggattcaccttcaatagctatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggacggggaggatacaggagctactttgactactggggccagggaaccctggtcaccgtctcctca

SEQ ID NO: 262 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaacacttttggccaggggaccaagctggagatcaaa

SEQ ID NO: 263 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagccaaggacgaatgtatgttcggggagtcgattatggtgtctactggggccagggaaccctggtcaccgtctcctca

SEQ ID NO: 264 - DNA, 339 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaaaatctctcatgctgtgttcggaggaggcacccagctgaccgtcctc

SEQ ID NO: 265 - DNA, 372 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcaattatttatagcggtggtagcacatactacgcagactccgtgaagggccgattcaccatctccagagacaattccaagaacacgctgtatcttcaaatgaacagcctgagagccgaggactcggccgtgtattcctgtgcgacgactatggttcggggacttattatatcatactactacggtatggacgtctggggccaagggaccacggtcaccgtctcctca

SEQ ID NO: 266 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctggtattcggcggagggaccaagctgaccgtccta

SEQ ID NO: 267 - DNA, 375 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgcgcgctggggcccttagatattgtagggtcctactactactacggtatggacgtctggggccaagggaccacggtcaccgtctcctca

SEQ ID NO: 268 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggagtccctgatcggttctctggctccatcgacagctcctccaactctgcctccctcaccatctctggactgaagactgaggacgaggctgactactactgtcagtcttatgatagcagcaatcaggatgtggtattcggcggagggaccaagctgaccgtccta

SEQ ID NO: 269 - DNA, 360 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagggtggcgggctaccttatacggtatggacgtctggggccaagggaccacggtcaccgtctcctca

SEQ ID NO: 270 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacttgggtgttcggcggagggaccaagctgaccgtccta

SEQ ID NO: 271 - DNA, 366 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggccaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagctggttcggggagtcggcactactacggtatggacgtctggggccaagggaccacggtcaccgtctcctca

SEQ ID NO: 272 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtacacactggcctccgacgttcggccaagggaccaaggtggaaatcaaa

SEQ ID NO: 273 - DNA, 375 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacaatggtggcacaaactctgcacagaagtttcagggcagggtcaccatgaccagggacacgtccatcagcacagcctacatggagctgaacaggctgagatctgacgacacggccgtgtattactgtgcgagagatatcaccacaacagctggtacggactactactacggtatggacgtctggggccaagggaccacggtcaccgtctcctca

SEQ ID NO: 274 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgttggtgatatgtaaagacagtgagaggccctcagggatccctgagcgattctctggctccagctcagggacaacagtcacgttgaccatcagtggagtccaggcagaagacgaggctgactattactgtcaatcagcagacagcagtggtacttatatagtcttcggaactgggaccaaggtcaccgtccta

SEQ ID NO: 275 - DNA, 366 bp, Homo sapiens
caggtgcagctggtgcaatctgggtctgagttgaagaagcctggggcctcagtgaagctttcctgccaggcctctgggtacaccttcagtaaccatgctatgaattgggtgcgccaggcccctggacaggggcttgagtggatgggatggatcaacaccaacactgggaacccaacatatgcccagggcttcacaggacggtttgtcttctctttggacacctctgtcggcacggcatatctgcacatcagcagcctaaaggctgaggacactgccttttattactgtgcgagagcgtctgcgcgtccgggtgttgcaacaaacttagacttctggggccagggaaccctggtcgtcgtctcctca

SEQ ID NO: 276 - DNA, 321 bp, Homo sapiens
gacatccagatgacccagtctccatcctccctgtctgcttctgtaggagacagagtcaccatcacttgccggacaagtcagaatattgacaactatttaaattggtatcagcagaaaccagggaaagcccctaacctcctgatctatgctgcatccagattgcatagtggggtcccatcaaggttcagtggcagtggatctgggacagattttactctcatcatcagcagtctacaacctgaagatcttgcaacttattactgtcaacagagttacagtaatcctctcactttcggccctgggaccaaagtggatatcaga

SEQ ID NO: 277 - DNA, 372 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcattcatagtggaagcaccaactacaacccgtccctcaagagtcgagtcaccatatcagtagacacgtccaagaaccagttctccctgaagctgagctctgtgaccgccgcggacacggctgtgtattactctgcgagacgtacgggattactatggttcagggagggttcgtactactttgactactggggccagggaaccctggtcaccgtctcctca

SEQ ID NO: 278 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccccctcactttcggcggagggaccaaggtggagatcaaa

SEQ ID NO: 279 - DNA, 366 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtcggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaggggcagtgggagctacagggcaatgcttttgatatctggggccaagggacaatggtcaccgtctcttca

SEQ ID NO: 280 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcaggagacagcagtggtacttatcgggtgttcggcggagggaccaagctgaccgtccta

SEQ ID NO: 281 - DNA, 336 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaaactgaactctgtgaccgctgcggacacggccgtgtattactgtgcgagaggttttgactactggggccagggaaccctggtcaccgtctcctca

SEQ ID NO: 282 - DNA, 324 bp, Homo sapiens
gaaattgtgttgacgcagtctccaggcaccctgtctttgtctccaggggaaagagccaccctctcctgcagggccagtcagagtgttagcagcatctacttagcctggtaccagcagaaacctggccaggctcccaggctcctcatctatggtgcatccagcagggccactgccatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaatcaaa

SEQ ID NO: 283 - DNA, 381 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatagtggctacgattgggccggggggcactactactactacggtatggacgtctggggccaagggaccacggtcaccgtctcctca

SEQ ID NO: 284 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtccta

SEQ ID NO: 285 - DNA, 372 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagccatcgatattttgactggttatggccctggtggtatggacgtctggggccaagggaccacggtcaccgtctcctca

SEQ ID NO: 286 - DNA, 330 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgtggtattcggcggagggaccaagctgaccgtccta

SEQ ID NO: 287 - DNA, 372 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattatagcggacaaatccacgagcacagcctacatggagctgagcagcctgagatctgaggacaaggccgtgtattactgtgcgagagaggggaaatctgatagcagcagcgccctttggtacttcgatctctggggccgtggcaccctggtcactgtctcccca

SEQ ID NO: 288 - DNA, 318 bp, Homo sapiens
tcctatgaggtgactcagccaccctcagtgtccgtgtccccaggacagacagccagcatcacctgctctggagataaattgggggataaatatgcttgctggtatcagcagaagccaggccagtcccctgtggtggtcatctataaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 289 - DNA, 384 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatgttgaaacaatctacgcacagaagttccagggcagagtcaccatgaccgaggacacatctacagacacagcctacatggagctgagcagcctgagatctgaggacacggccgtgtattactgtgcaacaggagtagcagtggttggtacttcccacagttactactactactacggtatggacgtctggggccaagggaccacggtcaccgtctcctca

SEQ ID NO: 290 - DNA, 321 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgccccattcactttcggccctgggaccaaagtggatatcaaa

SEQ ID NO: 291 - DNA, 348 bp, Homo sapiens
caggtgcagttggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtagtatcacaagctacgcacagaagttccagggcagagtcaccatgaccagggacacgtccacgagcacagtctacatggagctgagcagcctgagatctgaggacacggccgtgtattactgtgcgagagtgggcggtagtatggacgtctggggccaagggaccacggtcaccgtctcctca

SEQ ID NO: 292 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 293 - DNA, 372 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagattggcagtagatataagttttgacgggtccgacggtatggacgtctggggccaagggaccacggtcaccgtctcctca

SEQ ID NO: 294 - DNA, 321 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaagggggtcttcggaactgggaccaaggtcaccgtccta

SEQ ID NO: 295 - DNA, 372 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaagggctagcagcagctggcgcttacaactacggtatggacgtctggggccaagggaccacggtcaccgtctcctca

SEQ ID NO: 296 - DNA, 330 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacaatgtggtattcggcggagggaccaagctgaccgtccta

SEQ ID NO: 297 - DNA, 354 bp, Homo sapiens
gaggtgcaggtgttggagtctgggggaggcttggtacagcctggggggtccctgagactctcctgtgcagcctctggattcaccttgagcaactatgccatgagctgggtccgccaggctccagggaaggggctggagtgggtctcagctattagtggtagtggttatagcacatactacgcagactccgtgaagggccggttcaccatctccagagacacttccaagaacacgctgtctctgcaaatgaacagcctgagagccgaggacacggccgtatattactgtgcgaaagtcggccggtggtatgtctttgactactggggccagggaaccctggtcaccgtctcctca

SEQ ID NO: 298 - DNA, 321 bp, Homo sapiens
gacatccagatgacccagtctccatcctcactgtctacatctgtaggagacagagtcaccatcacttgccgggcgagtcagggcattagcaattttttagcctggtatcagcagaaaccagggaaagttcctaacctcctgatctttgatgcatccactttgcaatcaggggtcccatctcggttcagtggcagtggatctgggacagatttcactctcaccatcagcagcctacagcctgaagatgttgcaacttattactgtcaaaagtataacaatgccccattcactttcggccctgggaccaaagtggatatcaag

SEQ ID NO: 299 - DNA, 378 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaatgtggctgggattacgatttttgggttgggcagggctacggtatggacgtctggggccaagggaccacggtcaccgtctcctca

SEQ ID NO: 300 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgatgtggtattcggcggagggaccaagctgaccgtccta

SEQ ID NO: 301 - DNA, 399 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaggaacacgctgtatctgcaaatgaacagcctgagagctgaggacacggctgtgtattactgtgcgaaaggtgccgacaccccccattatagtggctacgattttttgtctgtcggctactactactacggtatggacgtctggggccaagggaccacggtcaccgtctcctca

SEQ ID NO: 302 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttccaaagtggggtcccatcaaggttcagtggcagtagatctgggacagatttcactctcaccatcagcagtctgcaacctgaagattttgcaacttactactgtcaacagagttacagtgctccattcactttcggccctgggaccaaagtggatatcaaa

SEQ ID NO: 303 - DNA, 375 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggacaacgtattactatgtttcggggagacgggccgagttcgacccctggggccagggaaccctggtcaccgtctcctca

SEQ ID NO: 304 - DNA, 333 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaaggggtattcggcggagggaccaagctgaccgtccta

SEQ ID NO: 305 - DNA, 375 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagaggtcgtattacgatttttggagtggaatactactacggtatggacgtctggggccaagggaccacggtcaccgtctcctca

SEQ ID NO: 306 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccttacacttttggccaggggaccaagctggagatcaaa

SEQ ID NO: 307 - DNA, 384 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaagtcagtcggttcagggagttatcggccattactactactactacggtatggacgtctggggccaagggaccacggtcaccgtctcctca

SEQ ID NO: 308 - DNA, 333 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttccctcctttggccaggggaccaagctggagatcaaa

SEQ ID NO: 309 - DNA, 387 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagttaccgtagaggcgatttttggagtggttatcttacccctaaaaaactggttcgacccctggggccagggaaccctggtcaccgtctcctca

SEQ ID NO: 310 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgaccctttatgtcttcggaactgggaccaaggtcaccgtccta

SEQ ID NO: 311 - DNA, 375 bp, Homo sapiens
gaggtgcagctggtggagtctggaggaggcttgatccagcctggggggtccctgagactctcctgtgcagcctctggattcaccgtcagtggcaactacatgaactgggtccgccaggctccagggaaggggctggagtgggtctcagttatttatagcggtggtagcacatactacgcagactccgtgaagggccgattcaccatctccagagccaattccaagaacacgctgtatcttcaaatgaacagcctgagagccgaggacacggccgtgtattactgtgcgagtacgtctttggttcggggacttattatattgtactactacggtatggacgtctggggccaagggaccacggtcaccgtctcctca

SEQ ID NO: 312 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcgtattcggcggagggaccaagctgaccgtccta

SEQ ID NO: 313 - DNA, 405 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatcctcccgggagggatttttggagtggttattattttggggctcccgattactactactactacggtatggacgtctggggccaagggaccacggtcaccgtctcctca

SEQ ID NO: 314 - DNA, 321 bp, Homo sapiens
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgtacacttttggccaggggaccaagctggagatcaaa

SEQ ID NO: 315 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaacccggggtgggagctactttgatgcttttgatatctggggccaagggacaatggtcaccgtctcttca

SEQ ID NO: 316 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtggacgttcggccaagggaccaaggtggaaatcaaa

SEQ ID NO: 317 - DNA, 360 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatctagcttggctatcagggggtatggacgtctggggccaagggaccacggtcaccgtctcctca

SEQ ID NO: 318 - DNA, 330 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcctgtcttcggaactgggaccaaggtcaccgtccta

SEQ ID NO: 319 - DNA, 378 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagctcctattatgattacatttgggggagttacgggtcactttgactactggggccagggaaccctggtcaccgtctcctca

SEQ ID NO: 320 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccctcactttcggcggagggaccaaggtggagatcaaa

SEQ ID NO: 321 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaggtctatcagtgggagctacttgggagcctttgactactggggccagggaaccctggtcaccgtctcctca

SEQ ID NO: 322 - DNA, 315 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttacacttttggccaggggaccaagctggagatcaaa

SEQ ID NO: 323 - DNA, 375 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagattggacccaaagtagtggctacgattactactacggtttggacgtctggggccaagggaccacggtcaccgtctcctca

SEQ ID NO: 324 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtggtggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtggtattcggcggagggaccaagctgaccgtccta

SEQ ID NO: 325 - DNA, 363 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacactgtatctgcaaatgaacagcctgagagccgaggacacggctgtgtattactgtgcgaaagatggtggagactacggtgacgttaactttgactactggggccagggaaccctggtcaccgtctcctca

SEQ ID NO: 326 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgttggtgatatataaagacagtgagaggccctcagggatccctgagcgattctctggctccagctcagggacaacagtcacgttgaccatcagtggagtccaggcagaagacgaggctgactattactgtcaatcagcaggcagcagtggtaattataaagtattcggcggagggaccaagctgaccgtccta

SEQ ID NO: 327 - DNA, 366 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggttatggttcggggagttattatccactatatctctactggggccagggaaccctggtcaccgtctcctca

SEQ ID NO: 328 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattccacttttggccaggggaccaagctggagatcaaa

SEQ ID NO: 329 - DNA, 369 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacgacatatctgcagatcagcagcctaaaggctgaggacactgccgtgtattactgtgcgagagtaattggagtggttacttactattactacggtatggacgtctggggccaagggaccacggtcaccgtctcctca

SEQ ID NO: 330 - DNA, 321 bp, Homo sapiens
gacatccagatgacccagtctccatcctccctgtctgcatctgtaggagacagagtcaccatcacttgccgggcaagtcagagtattagcagctatttaaattggtatcagcagaaaccagggaaagcccctaaactcctgatctatactgcatccagtttgcaaagtggggtcccatcaaggttcagtggcagtggatctgggacagatttcactctcaccatcagcagtctgcaacctgaagattttgcaacttactactgtcaacagagttacagtacccctcctacttttggccaggggaccaagctggagatcaaa

SEQ ID NO: 331 - DNA, 360 bp, Homo sapiens
gaggtgcagctagtggagtctggaggaggcttgatccagccgggggggtccctgagaatctcctgtgcagcctctgggttcaccgtcaggaacaaccacatgagctgggtccgccaggctccagggaaggggctggagtgggtctcagttttttatagaggtggtactacatactacgcagactccgtgaagggccgattcaccatctccagagacgattccaagaacacggtggatcttcaaatgaacagcctgagaggcgaggacacggccgtgtattactgtgcgagaggactgagtgtagcagcatctggttactttgactgttggggccagggaaccctggtcaccgtctcctca

SEQ ID NO: 332 - DNA, 321 bp, Homo sapiens
gacatccagatgacccagtctccatcttctgtgtctgcatctgtaggagacacagtcaccatcacttgtcgggcgaatcagggcattagcagctggttagcctggtatcagcaggtgccagggaaagcccctgagctcctgatctatgctacctccactttgcaaagtggggtcccatcaaggttcagcggcagtggatctgggacagatttcactctcactatcagcagcctgcagcctgaagattttgcaacttactattgtcaacaagctaacagtttcccattcactttcggccctgggaccaaagtggatatcaaa

SEQ ID NO: 333 - DNA, 366 bp, Homo sapiens
gaggtgcagctggtggagtctgggggaggcttggtccaggcgggggggtccctgagactctcctgtgcagcctctggattcacctttagtacccattggatgagctgggtccgccaggttccagggaaggggctggagtgggtggccaacataaaaaaagatggaggtgagaaatactatgtggactctgtgaagggccgattcaccatctccagagacaacgccaagagttcactgtttcttcaaatgaacagcctgagagccgaggacacggctgtgtatcactgtacgagagatgagggaaccagtggctggaactggtatttcgatctctggggtcgtggcaccctggtcactgtctcctca

SEQ ID NO: 334 - DNA, 321 bp, Homo sapiens
gaaatagtgatgacgcagtctccagccaccctgtctgtgcctccaggggaaagaaccaccctctcttgcagggccagtcagagtattgacatcaacttagcctggtaccagcagaaacctggccaggctcccaggcccctcatctatggtgcgtccaccagggccactggtatcccagccaggttcactggcagtgggtctcggacagagttcactctcaccatcagcagcctgcagtctgaagattttgcagtttattactgtcagcagtatgataactggcctcggacgttcggccaagggaccaaggtggaaatcaaa

SEQ ID NO: 335 - DNA, 360 bp, Homo sapiens
caggtgcagctgcaggagtcgggcccaggactggtgaagccttcacagaccctgtccctcacctgtactgtctctggtggctccatcaacagtggtgattactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtatattattgtgcgagagggacggtgactacgttctactttgactactggggccagggaaccctggtcaccgtctcctca

SEQ ID NO: 336 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacattatgataatctccccctcactttcggcggagggaccaaggtggagatcaaa

SEQ ID NO: 337 - DNA, 387 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagagagagaggtggatacggtggtaactattttttactactactactacggtatggacgtctggggccaagggaccacggtcaccgtctcctca

SEQ ID NO: 338 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 339 - DNA, 378 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacaggaccgaccctaggatattgtactggtggtgtatgctatctgtttgactactggggccagggaaccctggtcaccgtctcctca

SEQ ID NO: 340 - DNA, 333 bp, Homo sapiens
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacccctgcccggttctcaggctccctccttgggggcaaagctgccctgaccctttcgggtgcgcagcctgaggatgaggctgagtattactgcttgctctcctatagtggtgctcggctttatgtcttcggaactgggaccaaggtcaccgtccta

SEQ ID NO: 341 - DNA, 336 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaggctttgactactggggccagggaaccctggtcaccgtctcctca

SEQ ID NO: 342 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtacatccaccagggccactggcatcccagacaggttcagtggcagtgggtctgggacagacttcactctcaccatcagcagactggagcctgaagattttgcagtgtattactgtcagcattatggtagctcaccgtggacgttcggccaagggaccaaggtggaaatcaaa

SEQ ID NO: 343 - DNA, 375 bp, Homo sapiens; identical to SEQ ID NO: 83

SEQ ID NO: 344 - DNA, 330 bp, Homo sapiens
gaaattgtgttgacgcagtctccaggcaccctgtctttgtctccaggggaaagagccaccctctcctgcagggccagtcagagtgttagcagcagctacttagcctggtaccaacaaaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccgcgatacacttttggccaggggaccaagctggagatcaaa

SEQ ID NO: 345 - DNA, 354 bp, Homo sapiens
caggtgcacctggtggaggctgggggaggcgtggtccagcctgggaagtccctaagactctcctgtgcagcctcgggattcatcttcagtaactttggcatgcactgggtccgccagtctccaggcaaggggctggagtgggtggcagttgtgtcatatgatgcaagtgtcacaaaatattcagactcctttgagggccgattcaccatctccagagacaattccaagaatacattgtatctgcaaatggacagcctgagacctgaggactcggctgtctattactgtgcgaaaggccagggggcaaatcttcttcatgattggggccagggaatcctggtcaccgtctcctca

SEQ ID NO: 346 - DNA, 336 bp, Homo sapiens
gatgttgtgctgactcagtctccactctccctgcccgtcacccttggacagccggcctccatctcctgcaggtctagtgaaagcctcgtttacactgatggagacacctacttacattggtttcaccagaggccaggccaatctccaaggcgcctaatttataaggtttctaaccgggactctggcgtcccagacagattcagcggcagtgggtcaggcactgatttcacactgagaatcagcagggtggaggctgaggatgttggggtttattactgcatgcaaggtacacactggccattcactttcggccctgggaccaaagtggatatcaaa

SEQ ID NO: 347 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtggttggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagatccttccgcggtggctactactacggtatggacgtctggggccaagggaccacggtcaccgtctcctca

SEQ ID NO: 348 - DNA, 324 bp, Homo sapiens; identical to SEQ ID NO: 80

SEQ ID NO: 349 - DNA, 381 bp, Homo sapiens
caggtgcagctgcaggagtcgggcccaggactggtgaagccctcacagaccctgtccctcacgtgcactgtctctggtggctccatcagcagtggtggttattactggaactggatccgccagcacccagggaagggcctggagtggattgggtacatctatgacagtgggagcacctactacaacccgtccctcaagagtcgacttaccctttcaatagacacgtctcagaaccagttctccctgaggcggacctctgtgactgccgcggacacggccgtctattactgtgcgagagggcgtcagtatgactatgataggacgggtttacagtactactttgactactggggccagggaaccctggtcaccgtctcctca

SEQ ID NO: 350 - DNA, 324 bp, Homo sapiens
gaaattgtgttgacgcagtctccaggcaccctgtctttgtctccaggggaaagagccaccctctcctgcagggccagtcagagttttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcaacaatatggtacctcatctctcactttcggcggagggaccaaggtggagatcaaa

SEQ ID NO: 351 - DNA, 375 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagattacgaggtggtgattgctatagggggtcctggagcttttgactactggggccagggaaccctggtcaccgtctcctca

SEQ ID NO: 352 - DNA, 324 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatgtggtattcggcggagggaccaagctgaccgtccta

SEQ ID NO: 353 - DNA, 378 bp, Homo sapiens
caggtgcagctggtgcagtctggggctgaggtgaagaagcctggggcctcagtgcaggtctcctgcaaggcttctggatacaccttcagcgactactatatattctgggtgcgacaggcccctggacaagggcttgagtggatgggatgcatcaaccctaaaagtggtggcgcaatctatgcacagagatttcagggcagggtcaccatgaccagggacacgtccttcaacacagcctacatggagatgaacaggctgggatctgacgacacggccgtgtattactgtgtgactcgtggacctccggatatagcagcatctggtttcgcgtggcatttggacgtctggggccaagggaccacggtcaccgtctcctca

SEQ ID NO: 354 - DNA, 336 bp, Homo sapiens
gatattgtgatgactcagtctccactctccctgcccgtcacccctggagagccggcctccatctcctgcaggtctagtcagagcctcctgtctagtaatggatacaactatctggaatggtacctgcagaagccagggcagtctccacagctcctgatgtatttgggttctaatcgggcctccggggtccctgacaggttcagtgggagtggatcaggcacagattttacactgaaaatcaacagagtggaggctgaggatgttggagtttattactgcatgcaagctctacaaactccgctcactttcggcggagggaccaaggtggagatcaaa

SEQ ID NO: 355 - DNA, 372 bp, Homo sapiens
caggtgcagctggtgcagtctggggctgaggtgaagaagcctggggcctcagtgaaggtctcctgcaaggcttctggatacaccttcaccggcttctatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagtcgcataccagctgcgttactactactactacggtatggacgtctggggccaagggaccacggtcaccgtctcctca

SEQ ID NO: 356 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggccctgggaccaaagtggatatcaaa

SEQ ID NO: 357 - DNA, 366 bp, Homo sapiens
caggtgcaggtggtggagtctgggggaggcgtggtccagcctgggaggtccctgagactctcctgtgcagcctctggattcaccttcagttcctatgccatgcactgggtccgccaggctccaggcaaggggctggagtgggtggcagttatatcatatgatggaaataatgaatactacgtagaccccgtgaagggccgattcaccatctccagagacaattccaagaacacgctgtatctgcaaatgaacagcctgagagctgaggacacggctctgtattactgtgcgactagtagagaggctatagtagtgggtggcatactagactactggggccagggaaccctggtcaccgtctcctca

SEQ ID NO: 358 - DNA, 327 bp, Homo sapiens
gacatccagatgacccagtctccatcctccctgtctgcatctgtaggagacagagtcaccatcacttgccaggcgagtcacgacattaacaactttttaaattggtatcagcaaaaaccagggcaagcccctaagctcctgatctacgatgcatccaatttggaaacaggggtcccatcaaggttcagtggaagtggatctgggacagattttacgttcaccatcagcagcctgcacccagaagatgttgcaacatattactgtcaacagtatgatggtctccctcgctatgtcacttttggccaggggaccaagctggagatcaga

SEQ ID NO: 359 - DNA, 378 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatgagcgggagtattgtagtggtggtagctgcaacaactggttcgacccctggggccagggaaccctggtcaccgtctcctca

SEQ ID NO: 360 - DNA, 318 bp, Homo sapiens; identical to SEQ ID NO: 52

SEQ ID NO: 361 - DNA, 375 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagcagtagtaccatatactacgcagactctgtgaagggccgattcaccatctccagagacaacgccaagaactcactgtatctgcaaatgaacagcctgagagccgaggacacggctgtgtattactgtgcgagagacaggggatatagtgactacggcccctactactacggtatggacgtctggggccaagggaccacggtcaccgtctcctca

SEQ ID NO: 362 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacacatttcactctcaccatcagcagtctgcaacctgaagattttgcaacttactactgtcaacagagttacagtaccccgtacacttttggccaggggaccaagctggagatcaaa

SEQ ID NO: 363 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagacccccccggggcgggagctactaccctttcgacccctggggccagggaaccctggtcaccgtctcctca

SEQ ID NO: 364 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccccggacgttcggccaagggaccaaggtggaaatcaaa

SEQ ID NO: 365 - DNA, 375 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcggctattagtggtagtggtgttaacacataccacgcagactccgtgaagggccggttcaccatctccagagacaattccaggaacacgctgtatctgcaaatgagcagcctgacagccgaggacacggccgcatattactgtgcgaaagattttgaagcagctagtggtgcgtactactactacggtatggacgtctggggtcaagggaccacggtcaccgtctcctca

SEQ ID NO: 366 - DNA, 324 bp, Homo sapiens
tcctatgagctgacacagccaccctcggtgtcagtgtccccaggacagacggccaggatcacctgctctggagatgcattgccagaccaatatgcttattggtaccagcagaagccaggccaggcccctgtggtggtgatatataaagaccgtgagcggccctccgggatccctgagcgattctctggctccaactcagggacaacagtcacgttgaccatcagtggggtccaggcagaagacgaggctgactattactgtcaatcagcagacagcagtgctacttatgtggttttcggcggagggaccaagctgaccgtccta

SEQ ID NO: 367 - DNA, 360 bp, Homo sapiens
gaggtgcagctggtggagtctgggggaggtgtggtacggcctggggggtccctgagactctcctgtgcagcctctggattcacctttggtgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtattactgtgcgagtgacctggttcggggagttattggttttgactactggggccagggaaccctggtcaccgtctcctca

SEQ ID NO: 368 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtatcacgggggtgttcggcggagggaccaagctgaccgtccta

SEQ ID NO: 369 - DNA, 363 bp, Homo sapiens
caggtgcagctggtggagtctgggggaggcgtggtccagcctgggaggtccctgagactctcctctgcagcctctggattcaccttcagtagctatgctatgcactgggtccgccaggctccaggcaaggggctggagtgggtggcagttatatcatatgatggaagcaataaatactacgcagactccgtgaggggccgattcaccatctccagagacaattccaagaacacgctgtatctgcaaatgaacagcctgagagctgaggacacggctgtgtattactgtgcgagaccaaaaggggggagctactctgatgcttttgatatctggggccaagggacaatggtcaccgtctcttca

SEQ ID NO: 370 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcagagtttcggccctgggaccaaagtggatatcaaa

SEQ ID NO: 371 - DNA, 375 bp, Homo sapiens
cagatgcggttagaagagtcgggcccaggactggtgaaaccttcggagaccctgtccctcacttgcactgtggctggcggctccatcaccagcagtgattacttctggggctggctccgccagtcccccgggaagggacttgagtggattgcgagtacttatcatggtggcagtatccagtaccacccggccctcaagagtcgagtcaccatttcagttgacgcgtccaagaatcagatctccctgagactgagttctgtgaccgccgcggacacggccgtctattattgtgcgagagatcgcggcgatgacgggccaatggggacttactactttgaccactggggccagggtgccctggtcaccgtctcgtca

SEQ ID NO: 372 - DNA, 327 bp, Homo sapiens
caatctgtgctgacgcagccgccctcagtgtctggggccccaggtcagagtgtcacaatctcctgcgctgggtccagctccaacatcggggcaggtcatgatgtgcattggtatcagcaaattccaggaacagcccccaaactgctcatctgtggaaacacgaatcggccctcaggggtccctgaacgattctctggctccaggtctggcacctcagcctccctggccatcactgggctccaggctgaggatgaggctgtttattactgccagtcctatgaccccagccatgtcttcttcggcacagggaccaagctgaccgtccta

SEQ ID NO: 373 - DNA, 387 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagaacgtaaggtggtggtagctgctacgaggaattactactactactacggtatggacgtctggggccaagggaccacggtcaccgtctcctca

SEQ ID NO: 374 - DNA, 318 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtacttgggtgttcggcggagggaccaagctgaccgtccta

SEQ ID NO: 375 - DNA, 381 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatcctacagaagtgggagctacttcagaatactactactacggtatggacgtctggggccaagggaccacggtcaccgtctcctca

SEQ ID NO: 376 - DNA, 324 bp, Homo sapiens; identical to SEQ ID NO: 98

SEQ ID NO: 377 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaccaaatagtgggagctacttcgggtacttccagcactggggccagggcaccctggtcaccgtctcctca

SEQ ID NO: 378 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggtttttatgtcttcggaactgggaccaaggtcaccgtccta

SEQ ID NO: 379 - DNA, 348 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagataaaagttcgggtagtggcccctggggccagggaaccctggtcaccgtctcctca

SEQ ID NO: 380 - DNA, 321 bp, Homo sapiens
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccctcggacgttcggccaagggaccaaggtggaaatcaaa

SEQ ID NO: 381 - DNA, 369 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgattgagctactagaggggttctactactactacggtatggacgtctggggccaagggaccacggtcaccgtctcctca

SEQ ID NO: 382 - DNA, 330 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatccttacgtggtattcggcggagggaccaagctgaccgtccta

SEQ ID NO: 383 - DNA, 381 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcgggtatatgattacatttgggggagttatcgttactttgactactggggccagggaaccctggtcaccgtctcctca

SEQ ID NO: 384 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacggtggtattcggcggagggaccaagctgaccgtccta

SEQ ID NO: 385 - DNA, 366 bp, Homo sapiens
gaggtgcagctggtggagtctgggggaggcttggtccagcctggggggtccctgagactctcctgtgcagcctctgaattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagtaggggaatatagtggctacgatttgttctttgactactggggccagggaaccctggtcaccgtctcctca

SEQ ID NO: 386 - DNA, 333 bp, Homo sapiens
aattttatgctgactcagccccactctgtgtcggagtctccggggaagacggtaaccatctcctacaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaaggggtgttcggcggagggaccaagctgaccgtccta

SEQ ID NO: 387 - DNA, 357 bp, Homo sapiens
gaggtgcagctggtggagtctgggggaggcttggtccagcctggggggtccctgagactctcctgtgcagcctctggattcacctttagtacctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagactggggggcagcagctggtattttgactactggggccagggaaccctggtcaccgtctcctca

SEQ ID NO: 388 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactggggtcttcggaactgggaccaaggtcaccgtccta

SEQ ID NO: 389 - DNA, 378 bp, Homo sapiens
caggtgcagctggtggagtctgggggaggcttggtcaagcctggagggtccctgagactctcctgtgcagcctctggattcaccttcagtgactactacttgagctggatccgccaggctccagggaaggggctggaatgggtttcatacattagtagtagtggtagtaacatatactacgcagactctgtgaagggccgattcaccatctccagggacaacgccaagaactcactgtatctgcaaatgaacagcctgagagccgacgacacggccgtgttttactgtgcgagagcgggaagatactgtagtggtggtagctgccgcgttgaatacttccagcactggggccagggcaccctggtcaccgtctcctca

SEQ ID NO: 390 - DNA, 321 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgttggtgatatataaagacaatgagaggccctcagggatccctgagcgattctctggctccagctcagggacaacagccacgttgaccatcagtggagtccaggcagaagacgaggctgactactactgtcaatcagcagacagcagtggtactgtggtattcggcggagggaccaagctgaccgtccta

SEQ ID NO: 391 - DNA, 387 bp, Homo sapiens
caggtgcagctggtggagtctgggggaggcgtggtccagcctgggaggtccctgagactctcctgtgcagcctctggattcaccttcagtagctatgctatgtactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagataggccccattactatggttcggggaggaaaattttaaatctgtacggtatggacgtctggggccaagggaccacggtcaccgtctcctca

SEQ ID NO: 392 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaagtttcagcggcagtggatctgggacagaattcactctcacaatcagcagcctgcagcctgaagattttgcaacttattactgtcaacagcttaatagttaccctccattcactttcggccctgggaccaaagtggatatcaaa

SEQ ID NO: 393 - DNA, 384 bp, Homo sapiens
caggtgcagctggtgcagtctggggctgaggtgaagaagcctggggcctcactgaaggtctcctgcaaggcttctggatacatcttcaccggctactatatgcactgggtgcgacaggcccccggacaagggctagagtggatgggatggatcagcccgaacagtggtggcacaaaatatgcacagaaatttcagggcagggtcaccatgaccagggacacgtccatcagcacagcctacatggagctgagcaggctgagatctgacgactcggccgtgtattactgtgcgagagaaccttattacgatattttgactggttattatacaccgagacgctaccttgactactggggccagggaaccctggtcaccgtctcctca

SEQ ID NO: 394 - DNA, 330 bp, Homo sapiens
cagtctgccctgactcagcctgcctccgtgtctgggtctcctggacagtcgatcaccatctcctgcactggaaccagcagtgacgttggtgattataactatgtctcctggtaccagcaacacccaggcaaagtccccaaactcatgatttatgatgtcagtcatcggccctcaggggttaccaatcgcttctctggctccaagtctggcaacacggcctccctgaccatctctgggctccgggctgaggacgaggctgattattactgcagctcatatacaagcagcagcacttatgtcttcggcactgggaccaaggtcaccgtccta

SEQ ID NO: 395 - DNA, 387 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagagattcgatagtagtaccagctgctataatctctggctactactactacggtatggacgtctggggccaagggaccacggtcaccgtctcctca

SEQ ID NO: 396 - DNA, 333 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggccgggtattcggcggagggaccaagctgaccgtccta

SEQ ID NO: 397 - DNA, 366 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagatggttcggggagttattacctttcgtactactttgactactggggccagggaaccctggtcaccgtctcctca

SEQ ID NO: 398 - DNA, 327 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgagtcacacttttggccaggggaccaagctggagatcaaa

SEQ ID NO: 399 - DNA, 369 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagatccgtctagcagcagctggtcctactggtacttcgatctctggggccgtggcaccctggtcactgtctcctca

SEQ ID NO: 400 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctttcaccttcggccaagggacacgactggagattaaa

SEQ ID NO: 401 - DNA, 363 bp, Homo sapiens
caggtgcagttggtggagtctgggggaggcgtggtccagcctgggaggtccctgagactctcctgtgcagcctctgaattcaccttcgcaacctatgctatgcactgggtccgccaggctccaggcaaggggctggagtgggtggcacttatatcacaagatggaagcaataaacattacgcagactccgtgaagggccgattcaccatctccagagacaattccaagaacacactgtatctgcaaatgaacagcctgagagctgagggcacggccatatattactgtgcgagagagagtttagaagcagctggccccccctttgactactggggccagggaaccctggtcaccgtctcctca

SEQ ID NO: 402 - DNA, 321 bp, Homo sapiens
tcctatgagttgactcagccaccctcagtgtccgtgtccccaggacagacagccaccattatctgctctggagataaattgggggagaaatatgcttcctggtatcagcagaagccaggccagtcccctgcgctggtcatctatcaagataggaagcggccctcagggatccctgagcgattctctggctccaactctgggaacacagccactctgaccatcagcgggacccaggctatggatgaggctgactattactgtcaggcgtgggacagcagtaattctgtggtattcggcggagggaccaagctgaccgtccca

SEQ ID NO: 403 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaccccatagtgggagctacttctcctactttgactactggggccagggaaccctggtcaccgtctcctca

SEQ ID NO: 404 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccctttttggccaggggaccaagctggagatcaaa

SEQ ID NO: 405 - DNA, 363 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaaagatctctatagtgggagctactcgtttgttgactactggggccagggaaccctggtcaccgtctcctca

SEQ ID NO: 406 - DNA, 333 bp, Homo sapiens
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgagacaagcaacaaacactcctggacccctgcccggttctcaggctccctccttgggggcaaagctgccctgaccctttcgggtgcgcagcctgaggatgaggctgagtattactgcttgctctcctatagtggtgctcggcggggagtgttcggcggagggaccaagctgaccgtccta

SEQ ID NO: 407 - DNA, 375 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagcaacccagcagctggccaggaagcttactactactacggtatggacgtctggggccaagggaccacggtcaccgtctcctca

SEQ ID NO: 408 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtcttcggaactgggaccaaggtcaccgtccta

SEQ ID NO: 409 - DNA, 381 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaaataataaatactatgcagactccgtgaagggccgattcaccatctccagagacaattccaagaacacgctgtatctgcaaatgaacagcctgagagccgaggacacggctgtgtattactgtgcgaaagaccctacatggttcggggagttaccctcctactactactacggtatggacgtctggggccaagggaccacggtcaccgtctcctca

SEQ ID NO: 410 - DNA, 324 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatcccccgatcaccttcggccaagggacacgactggagattaaa

SEQ ID NO: 411 - DNA, 363 bp, Homo sapiens
caggtgcagctggtggagtctgggggaggcgtggtccagcctgggaggtccctgagactctcctgtgtagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatagggttggtggatacagctacctttttgactactggggccagggaaccctggtcaccgtctcctca

SEQ ID NO: 412 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccgacgttcggccaagggaccaaggtggaaatcaaa

SEQ ID NO: 413 - DNA, 363 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcccgagcttttggagtggcaaactggttcgacccctggggccagggaaccctggtcaccgtctcctca

SEQ ID NO: 414 - DNA, 333 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtctttatgtcttcggaactgggaccaaggtcaccgtccta

SEQ ID NO: 415 - DNA, 375 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcactacagcccatctctgaagagcaggctcaccatcaccaaggacacctccaaaaaccaggtggtccttacaatgaccaacatggaccctgtggacacagccacatattactgtgcacacatgtattacgatattttgagtggttattactacggtatggacgtctggggccaagggaccacggtcaccgtctcctca

SEQ ID NO: 416 - DNA, 333 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtcgttgggtgttcggcggagggaccaagctgaccgtccta

SEQ ID NO: 417 - DNA, 369 bp, Homo sapiens
gaagtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatatatctcctatagtgggagctactctcggtatggacgtctggggccaagggaccacggtcaccgtctcctca

SEQ ID NO: 418 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctcccactttcggcggagggaccaaggtggagatcaaa

SEQ ID NO: 419 - DNA, 381 bp, Homo sapiens
caggttcagctggtgcagtctggagctgaggtgaagaagcctggggcctcagtgaaggtctcctgcaaggcttctggttacacctttattagttatggtatcagctgggtgcgacaggcccctggacaagggcttgagtggatgggatggatcagcgcttacaatggtaacacaaactatgcacagaagctccagggcagagtcaccatgaccacagacacatctacgagcacagcctacatggagctgaggagcctgagatctgacgacacggccgtgtattactgtgcgagaggtttatggccggggtattactatggttcggggagttattctgcttttcatatctggggccaagggacaatggtcaccgtctcttca

SEQ ID NO: 420 - DNA, 327 bp, Homo sapiens
cagtctgccctgactcagcctccctccgcgtccgggtctcctggacagtcagtcagcatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattattgcagctcatatgcaggcagcaacaaggtattcggcggagggaccaagctgaccgtccta

SEQ ID NO: 421 - DNA, 372 bp, Homo sapiens
caggtgcagctggtggagtctgggggaggcgtggtccagcctgggaggtccctgagactctcctgtgcagcctctggattcaccttcagtatctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgggaagcttgcccgccggttcttactactactactacggtatggacgtctggggccaagggaccacggtcaccgtctcctca

SEQ ID NO: 422 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacaacagtggtacttatgtgctattcggcggagggaccaagctgaccgtccta

SEQ ID NO: 423 - DNA, 360 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctcctctccgtagggtggtcctttgactactggggccagggaaccctggtcaccgtctcctca

SEQ ID NO: 424 - DNA, 324 bp, Homo sapiens; identical to SEQ ID NO: 98

SEQ ID NO: 425 - DNA, 384 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagacttcaggggtatagtggctacgattataggggggactactactacggtatggacgtctggggccaagggaccacggtcaccgtctcctca

SEQ ID NO: 426 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcactttggtgttcggcggagggaccaagctgaccgtccta

SEQ ID NO: 427 - DNA, 381 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaacaatactcgccctattgtagtggtggtagctgctactccggagcgtccgactactggggccagggaaccctggtcaccgtctcctca

SEQ ID NO: 428 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcagacttttggccaggggaccaagctggagatcaaa

SEQ ID NO: 429 - DNA, 339 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtaccacacactacgcagactccgtgaagggccgattcaccatctccagagacaattccaagaacacgctgtatcttcaaatgaacagcctgagagccgaggacacggccgtgtattactgtgcgaactacggtatggacgtctggggccaagggaccacggtcaccgtctcctca

SEQ ID NO: 430 - DNA, 312 bp, Homo sapiens
tcctatgagctgacacagccatcctcagtgtcagtgtctccgggacagacagccaggatcacctgctcaggagatgtactggcaaaaaaatatgctcggtggttccagcagaagccaggccaggcccctgtgctggtgatttataaagacagtgagcggccctcagggatccctgagcgattctccggctccagctcagggaccacagtcaccttgaccatcagcggggcccaggttgaggatgaggctgactattactgttactctgcggctgacaaggtattcggcggagggaccaagctgaccgtccta

SEQ ID NO: 431 - DNA, 378 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagagtccgttgaatatagtggctacgaatactactactacggtatggacgtctggggccaagggaccacggtcaccgtctcctca

SEQ ID NO: 432 - DNA, 324 bp, Homo sapiens; identical to SEQ ID NO: 56

SEQ ID NO: 433 - DNA, 375 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatcggcaaatgaacagtctgagagccgaggacacggctgtgtattactgcgcgctggggcccttagatattgtagggtcctactactactacggtatggacgtctggggccaagggaccacggtcaccgtctcctca

SEQ ID NO: 434 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaggatgtggtattcggcggagggaccaagctgaccgtccta

SEQ ID NO: 435 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtgacatttatatcacatgagggaagcaataaatactacgcagactccgtgaagggccgattcaccatctccagagacaattccaagaacacgctgtatctgcaaatgaacagcctgagagctgaggacacggctgtatattactgtgcgaggactttcgagtatagcagctcgtcggctaccggggactttgactactggggccagggaaccctggtcaccgtctcctca

SEQ ID NO: 436 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggtgtggtattcggcggagggaccaagctgaccgtccta

SEQ ID NO: 437 - DNA, 375 bp, Homo sapiens
caggtgcagctggtgcaatctgggtctgagttgaagaagcctggggcctcagtgaaggtttcctgtaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactggcgtgtattactgtgcgagagaccatgagctaccaaatagcagcagctggttcgggcactttgagtactggggccagggaaccctggtcaccgtctcctca

SEQ ID NO: 438 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaaggcaggccaggcccctgtgttggtgatatataaagacagtgagaggcgctcagggatccctgagcgattctctggctccagctcagggacaacagtcacgttgaccatcagtggagtccaggcagaagacgaggctgactattactgtcaatcagcagacagcagtggtacttccgtggtattcggcggagggaccaagctgaccgtccta

SEQ ID NO: 439 - DNA, 393 bp, Homo sapiens
caggtgcagctggtggagtctgggggaggcgtggtccagcctgggaggtccctgagactctcctgtgcagcctctggaatcaccttcagtagctatgctatgcactgggtccgccaggctccaggcaaggggctggagtgggtggcagttatatcgtatgatggaagtgacaaataccatgcagactccgtgaagggccgattcgccatctccagagacaattccaagaacacgctgtatctgcaaatgaacagcctgagagctgaggacacggctgtgtattactgtgcgaaagataagggtatagcagtggctggtacgggttggatcagaccagatccagagtactactttgactactggggccagggaaccctggtcaccgtctcctca

SEQ ID NO: 440 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccggtgttcggccaagggaccaaggtggaaatcaaa

SEQ ID NO: 441 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggacgtaataaatactacgcagactccgtgaagggccgattcaccatctccagagacaattccaagaacacgctgtatctgcaaatgaacagcctgagagctgaggacacggctgtgtattactgtgcgagaccttgggggtctatggttcggggagttacatactttgactactggggccagggaaccctggtcaccgtctcctca

SEQ ID NO: 442 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 443 - DNA, 384 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaacgccaagaactcactgtatctgcaaatgaacagcctgagagccgaggacacggctgtatattactgtgcgagagatctaggggcacggaccccgtgggatattgtagtagtaccagctgctatggactactggggccagggaaccctggtcaccgtctcctca

SEQ ID NO: 444 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtaggtcaccgaacacttttggccaggggaccaagctggagatcaaa

SEQ ID NO: 445 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaaataataaatactacgcagactccgtgaagggccgattcaccatctccagagacaattccaagaacacgctgtatctgcaaatgaacagcctgagagctgaggacacggctgtgtattactgtgtgaggaccaatagtgggagctactacgcggcgtttgactactggggccagggaaccctggtcaccgtctcctca

SEQ ID NO: 446 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaaactcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaa

SEQ ID NO: 447 - DNA, 348 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagccgaggacacggccgtgtattactgtgcgagagaggtggctggtacctatgactactggggccagggaaccctggtcaccgtctcctca

SEQ ID NO: 448 - DNA, 324 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaaactcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccctggaggcactttcggccctgggaccaaagtggatatcaaa

SEQ ID NO: 449 - DNA, 360 bp, Homo sapiens
gaggtgcagctggtggagtctgggggaggcttggtccagcctggggggtccctgaggctctcctgtgcagcctctggattcacctttagtagctattggatgacctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagaggggtcggcagctggtacctgggctttgactactggggccagggaaccctggtcaccgtctcctca

SEQ ID NO: 450 - DNA, 330 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatggcagctcttatgtcttcggaactgggaccaaggtcaccgtcctc

SEQ ID NO: 451 - DNA, 384 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattattgtgcgagagccccagaagagaagtcgtctgagatcggggagttagttggttggggctggttcgacccctggggccagggaaccctggtcaccgtctcctca

SEQ ID NO: 452 - DNA, 318 bp, Homo sapiens
tcctatgagctgactcagccaccctcagtgtccgtgtccccaggacagacagccagtatcatctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 453 - DNA, 369 bp, Homo sapiens
gaggtgcagctgttggagtctgggggaggcttggtacagcctggggggtccctgagactctcctgtgcagcctctggattcacctttagcagctatgccatgagctgggtccgccaggttccagggaaggggctggagtgggtctcaggtattagtggtagtggtggtagcacatactacgcagactccgtgaagggccggttcaccatctccagagacaattccaagaacacgctgtatctgcaaatgaacagcctgagagccgaggacacggccgtatattactgtgcgaaacacggggagaggtatagcagtctgggatactactttgactactggggccagggaaccctggtcaccgtctcctca

SEQ ID NO: 454 - DNA, 321 bp, Homo sapiens; identical to SEQ ID NO: 62

SEQ ID NO: 455 - DNA, 369 bp, Homo sapiens
caggtgcagctgcaggagtcgggcccaggactggtgaagccttcggggaccctgtccctcacctgcgctgtctctggtgcctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagaaggtcctactatggttcagggagttattacccctttgactactggggccagggaaccctggtcaccgtctcctca

SEQ ID NO: 456 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagaaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 457 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcgggttcggggagttattttagctggttcgacccctggggccagggaaccctggtcaccgtctcctca

SEQ ID NO: 458 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagaagtatggtagctcaatcactttcggccctgggaccaaagtggatatcaaa

SEQ ID NO: 459 - DNA, 381 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagaggtcctttggatttttggagtggttattttaggctgcgctactttgactgctggggccagggaaccctggtcaccgtctcctca

SEQ ID NO: 460 - DNA, 330 bp, Homo sapiens; identical to SEQ ID NO: 244

SEQ ID NO: 461 - DNA, 345 bp, Homo sapiens
gaggtgcagctggtggagtctggaggaggcttgatccagcctggggggtccctgagactctcctgtgcagcctctgggttaaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagatccccctacggtggtaactcctggggccagggaaccctggtcaccgtctcctca

SEQ ID NO: 462 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcccgatcaccttcggccaagggacacgactggagattaaa

SEQ ID NO: 463 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagccggttcggggaattattataactggttcgacccctggggccagggaaccctggtcaccgtctcctca

SEQ ID NO: 464 - DNA, 324 bp, Homo sapiens
gaaatagtgatgacgcagtctccagccaccctgtctgtgtctccaggggaaagagccaccctctcctgcagggccagtcagactgttagcagcaacttagtctggtaccagcagaaacctggccaggctcccaggctcctcatctatggtgcatccaccagggccactggtatcccagccagattcagtggcagtgggtctgggacagagttcactctcaccatcagcagcctgcagtctgaagattttgcagtttattactgtcagcagtataataactggcctccgtacacttttggccaggggaccaagctggagatcaaa

SEQ ID NO: 465 - DNA, 378 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaactctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagtggggccctattactatgatagtagtggttattacaactactttgactactggggcccgggaaccctggtcaccgtctcctca

SEQ ID NO: 466 - DNA, 327 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggggatcaccttcggccaagggacacgactggagattaaa

SEQ ID NO: 467 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagatcccggggggggagctactcgaatgcttttgatatctggggccaagggacaatggtcaccgtctcttca

SEQ ID NO: 468 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatcacctcggactcactttcggcggagggaccaaggtggagatcaaa

SEQ ID NO: 469 - DNA, 366 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatgggatattgtggtggtggtggggctactttgactactggggccagggaaccctggtcaccgtctcctca

SEQ ID NO: 470 - DNA, 330 bp, Homo sapiens
cagtctgtgctgacgcagccgccctcagtgtctggggccccagggcagagggtcaccatctcctgcactgggagcagctccaacatcggggcaggttttgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtgtggtattcggcggagggaccaagctgaccgtccta

SEQ ID NO: 471 - DNA, 372 bp, Homo sapiens
gaggtgcagctggtggagtctggaggaggcttgatccagcctgggaggtccctgagactctcctgtgcagcctctgggttcaccgtcagtatcacctacatgagctgggtccgccaggctccagggaaggggctggagtgggtctcacttatttatagcggtggtagctcatactacgcagactccgtgaagggccgattcaccatctccagagacaattccaagaacacgctgtatcttcaaatgaacagcctgagagccgaggacacggccgtgtattactgtgcgacgactatggttcggggagttattatatcatactactacggtatggacgtctggggccaagggaccacggtcaccgtctcctca

SEQ ID NO: 472 - DNA, 330 bp, Homo sapiens; identical to SEQ ID NO: 266

SEQ ID NO: 473 - DNA, 351 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacattctacgcagactccgtgaagggccgattcaccatctccagagacaattccaagaacacgctgtatcttcaaatgaacagcctgagagctgaggacacggctgtgtattactgtgcgagagattcaggtgaccaattgctcgactactggggccagggaaccctggtcaccgtctcctca

SEQ ID NO: 474 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccccccattcactttcggccctgggaccaaagtggatatcaaa

SEQ ID NO: 475 - DNA, 372 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaagaaccaggtggtccttataatgaccaacatggaccctgtggacacagccacatattactgtgcacacagggatagcagcagctggttcgacttagatgcttttgatatctggggccaagggacaatggtcatcgtctcttca

SEQ ID NO: 476 - DNA, 330 bp, Homo sapiens
cagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacaggctgaatggtccggtattcggcggagggaccaagctgaccgtccta

SEQ ID NO: 477 - DNA, 390 bp, Homo sapiens
caggtgcagctggtgcagtctggggctgaggtgaagaagcctggggcctcagtgaaggtctcctgcaaggcttctggatacaccttcaccgactactatatacactgggtgcgacaggcccctggacaagggcttgagtggatgggatggatcaaccctaacagtggtggcactaactatgcacagaagtttcagggcaggctcaccatgaccagggacacgtccatcagcacagcctacatggagctgagcaggctgagatctgacgacacggccgtttattactgtgcgagagtgtatagtatgtttcgggaatttattataaatccctactactactactacggtttggacgtctggggccaagggaccacggtcaccgtctcctca

SEQ ID NO: 478 - DNA, 330 bp, Homo sapiens
cagtctgccctgactcagcctgcctccgtgtctgggtctcctagacagtcgatcaccatctcctgcactggcaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctggcaatctctgggctccaggctgaggacgaggctaattattactgctgctcatatgcaggtagtagcactttggtattcggcggagggaccaagctgaccgtccta

SEQ ID NO: 479 - DNA, 372 bp, Homo sapiens
caggtgcagctgcaggagtcgggcccaggactggtgaagccttcacagaccctgtccctcacctgcactgtctctggtggctccatcaacagttttggttactactggagctggatccgccagcacccagggaagggcctggagtggattgggtacatctattacagtgggagtaccgactacaacccgtccctcaacagtcgagttaccatttcactagacacgtctaagaaccagtttttactgaagctgacctctgtgactgccgcggacacggccgtgtattactgtgcgaaactgactgattactatgatagtagtggttattcctttgactactggggccagggaaccctggtcaccgtctcctca

SEQ ID NO: 480 - DNA, 321 bp, Homo sapiens
gacatccagatgacccagtctccatcttccgtgtctgcatctgtaggagacagagtcaccatcacttgtcgggcgagtcaggatattagcaggtggttagcttggtatcagcagaaaccagggaaagcccctaagctcctgatctatgctgcctccagtttgcaaagtggggtcccatcaaggttcagcggcaggggatctgggacagaattgactctcaccatcagcagcctgcagcctgaagattttgcaacttacttttgtcaacaggcttacagtttccccttcactttcggcggagggaccaaggtggagatcaaa

SEQ ID NO: 481 - DNA, 384 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggaccctatggttcggggagaatgtatttctactactactacggtatggacgtctggggccaagggaccacggtcaccgtctcctca

SEQ ID NO: 482 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttctttcgtggtattcggcggagggaccaagctgaccgtccta

SEQ ID NO: 483 - DNA, 360 bp, Homo sapiens
gaggtgcagctggtggagtctgggggaggcctggtcaagcctggggggtccctgagactctcctgtgcagcctctggattcaccttcagtagttatagcatgaattgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagcgcccgctgggatagtagtcggccctgactactggggccagggaaccctggtcaccgtctcctca

SEQ ID NO: 484 - DNA, 336 bp, Homo sapiens
aattttatgctgactcagccccactctgtgtcggagtctccggggaagacggtaaccatctcctgcaccggcagcagtggcagcattgccagcaactatgtacagtggtaccagcagcgcccgggcagtgcccccaccactgtgatctttgaggataaccaaagaccctctggggtccctgatcggttctctggctccatcgacagctcctccaactctgcctccctcaccatctctggactgaagactgaggacgaggctgactactactgtcagtcttatcatagcagcaatccccatgtggtattcggcggagggaccaagctgaccgtccta

SEQ ID NO: 485 - DNA, 357 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgaaaagtagagatggctacaagctttttgatatctggggccaagggacaatggtcaccgtctcttca

SEQ ID NO: 486 - DNA, 324 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatcccatgtacacttttggccaggggaccaagctggagatcaaa

SEQ ID NO: 487 - DNA, 363 bp, Homo sapiens
caggtgcagctggtgcagtctggggctgaggtgaagaagcctggggcctctgtgaaggtttcctgcaaggcatctggatacaccttcaccagctactatgtccactgggtgcgacaggcccctggacaaagtcttgagtggatgggagtaatcagccctagtactggtagcacaacctacgcacagaacttccagggcagagtcaccatgaccagggacacgtccacgaccacagtctacatggagctgagcagcctgagatctgaggacacggccgtgtattactgtgcgagagacgattactatgatagtaccagatacttcgatctctggggccgtggcaccctggtcactgtctcctca

SEQ ID NO: 488 - DNA, 330 bp, Homo sapiens
cagtctgccctgactcagcctgcctccgtgtctgggtctcctggacagtcgatctccttctcctgcactggaaccagcagtgacattggtgcttataactatgtctcctggtaccaacaacacccaggcagagcccccaaactcatgatttatgatgtcggtaatcggccctcaggggtttctaatcgcttctctggctccaagtctggcaacacggcctccctgaccatctctggactccaggctgaggacgaggctgattattactgcagctcatatacaagcagcagcactcaggtcttcggaactgggaccaaggtcaccgtcctg

SEQ ID NO: 489 - DNA, 381 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacggccacgagcacagtctacatggagctgagcagcctgagatctgaggacacggccgtgtattactgtgcgagaggagggggccagattagtatgataatagtggttatggatgatgcttttgatatctggggccaagggacaatggtcaccgtctcttca

SEQ ID NO: 490 - DNA, 321 bp, Homo sapiens
gaaatactgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgtacacttttggccaggggaccaagctggagatcaaa

SEQ ID NO: 491 - DNA, 384 bp, Homo sapiens
caggtccagctggtacagtctggggctgaggtgaggaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagccccggcagtggctggcactactaaaaattactactactactacggtatggacgtctggggccaagggaccacggtcaccgtctcctca

SEQ ID NO: 492 - DNA, 336 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttgtctggggtcccagacagattcagtggcagtggggcagggacagatttcacactgaaaatcagcagggtggaagctgaggatgtcggggtttattactgcatgcaagctacacaatttccgtacacttttggccaggggaccaagctggagatcaaa

SEQ ID NO: 493 - DNA, 384 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaggagggggagggggatattgtagtggtggtagctgctactcccactactttgactactggggccagggaaccctggtcaccgtctcctca

SEQ ID NO: 494 - DNA, 318 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccactttcggccctgggaccaaagtggatatcaaa

SEQ ID NO: 495 - DNA, 381 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgaatcaccatctccagagacaacgccaagaactcactgtatctgcaaatgaacagcctgagagccgaggacacggctgtgtattactgtgcgagagaatatcccaactttcgcgcggagtggttattatcgccctacggtatggacgtctggggccaagggaccacggtcaccgtctcctca

SEQ ID NO: 496 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacttctgttaaagtcttcggaactgggaccaaggtcaccgtccta

SEQ ID NO: 497 - DNA, 357 bp, Homo sapiens
cagatcaccttgaaggagtctggtcctacgctggtgaaacccacacagaccctcacgctgacctgcaccttctctgggttctcactcagcaccagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacaccattcgcttagtagcatctttgactactggggccagggaaccctggtcaccgtctcctca

SEQ ID NO: 498 - DNA, 327 bp, Homo sapiens
cagtctgccctgactcagcctgcctccgtgtctgggtctcctggacagtcgatcaccatctcctgcactggaaccagcagtgacgttggtgattataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactgtattcggcggagggaccaagctgaccgtccta

SEQ ID NO: 499 - DNA, 354 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggaacaccaactacaacccgtccctcaagagtcgagtcaccatatcagtagacaagtccaagaaccagttctccctgaagctgagctctgtgaccgccgcggacacggccgtgtattactgtgcgagacgggagtggctacgattgtttgactactggggccagggaaccctggtcaccgtctcctca

SEQ ID NO: 500 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 501 - DNA, 381 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgccgtggagaatatgattacatttgggggagttatcgttaaacggggtgcttttgatatctggggccaagggacaatggtcaccgtctcttca

SEQ ID NO: 502 - DNA, 324 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctattcactttcggccctgggaccaaagtggatatcaaa

SEQ ID NO: 503 - DNA, 360 bp, Homo sapiens
caggtgcagctggtggagtctgggggaggcgtggtccagcctgggaggtccctgagactctcctgtgcagcctctggttttaacctcagcagctatgctatgcactgggtccgccaggcatcaggcaaggggctggagtgggtgtcacttatatcatatgatggaagtattaaatattacacagactccgtgaagggccgattcaccgtctccggagacaattccaagaacacgctgtttctgcaaatgaacagcctgcgagctgacgactcggctctttattactgtgtgaggggcggtgtcagtggccccaattcttttgatctgtggggccaagggacaacggtcaccgtctcttcg

SEQ ID NO: 504 - DNA, 336 bp, Homo sapiens; identical to SEQ ID NO: 216

SEQ ID NO: 505 - DNA, 360 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagagaggggcagtggctgtataggtttgactactggggccagggaaccctggtcaccgtctcctca

SEQ ID NO: 506 - DNA, 330 bp, Homo sapiens
cagtctgccctgactcagcctgcctccgtgtctgggtctcctggacagtcgatcaccatctcctgcactggaaccagcagtgatgttgggaattatgaccttgtctcctggtaccaacagcacccaggcaaagcccccaaactcgtgatttatggcgtcactaagcggccctccggggtttctaatcgcttctctggctccaagtctggcaacacggcctccctgacaatctctgggctccaggctgaggacgaggctgattattactgctgctcatatgcaactggtgacacttctgtcttcggaactgggaccaaggtcaccgtccta

SEQ ID NO: 507 - DNA, 378 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagcgaaaaagtggatttttggagtgggggaccctactacggtatggacgtctggggccaagggaccacggtcaccgtctcctca

SEQ ID NO: 508 - DNA, 330 bp, Homo sapiens
cagtctgccctgactcagcctgcctccgtgtctgggtctcctggacagtcgatcaccatctcctgcactggaaccagcagtgacgttggtagttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcatcagcactctggtattcggcggagggaccaagctgaccgtccta

SEQ ID NO: 509 - DNA, 384 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatgagggagattgtactggtggtgtatgctatacatactactttgactactggggccagggaaccctggtcaccgtctcctca

SEQ ID NO: 510 - DNA, 324 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcatccgtggtattcggcggagggaccaagctgaccgtccta

SEQ ID NO: 511 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcgggttcggggagttattacaactggttcgacccctggggccagggaaccctggtcaccgtctcctca

SEQ ID NO: 512 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactccttatgtcttcggaactgggaccaaggtcaccgtccta

SEQ ID NO: 513 - DNA, 393 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagattgtaaatacgatattttgactggtcactattcggcggggtactactactacggtatggacgtctggggccaagggaccacggtcaccgtctcctca

SEQ ID NO: 514 - DNA, 321 bp, Homo sapiens
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgttcactttcggcggagggaccaaggtggagatcaaa

SEQ ID NO: 515 - DNA, 372 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagtatagcagcagctggtactttgtactactactacggtatggacgtctggggccaagggaccacggtcaccgtctcctca

SEQ ID NO: 516 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcaatgtggtattcggcggagggaccaagctgaccgtccta

SEQ ID NO: 517 - DNA, 372 bp, Homo sapiens
caggtggagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcaatagacacgtccaagaaccagttctccctgaagctgagctctgtgaccgccgcggacacggctgtgtattactgtgcgagagggactacagtaactactttcttcgccccccactggtacttcgatctctggggccgtggcaccctggtcactgtctcctca

SEQ ID NO: 518 - DNA, 333 bp, Homo sapiens
cagtctgccctgactcagcctgcctccgtgtctgggtctcctggacagtcgatcaccatctcctgcactggaaccagcagtgacgttggtggttataattatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggaactgggaccaaggtcaccgtccta

SEQ ID NO: 519 - DNA, 360 bp, Homo sapiens
caggtgcagctggtggagtctgggggaggcgtggtccagcctgggaggtccctgagactctcctgtgcagcctctggttttaacctcagcaactatgctatgcactgggtccgccaggcatcaggcaaggggctggagtgggtgtcacttatatcatatgatggaagtattaaatattacacagactccgtgaagggccgattcaccgtctccggggacaattccaagaacacactgtttctgcaaatgaacagcctgcgagctgacgactcggctctttattactgtgtgaggggcggtgtcagtggcccaaattcttttgacatgtggggccaagggacaacggtcaccgtctcttcg

SEQ ID NO: 520 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttggggtttattactgcatgcaaggtacacactggccggtgacgttcggccaagggaccaaggtggaaatcaaa

SEQ ID NO: 521 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaaaccttatagtgggagctactgggatgcttttgatatctggggccaagggacaatggtcaccgtctcttca

SEQ ID NO: 522 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgctcactttcggcggagggaccaaggtggagatcaaa

SEQ ID NO: 523 - DNA, 357 bp, Homo sapiens
caggtgcagctggtggagtctgggggaggcgtggtccagcctgggaggtccctgagactctcctgtgcagcctctggattcaccttcaatagctatgctatgcactgggtccgccaggctccaggcaaggagctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagggggaggcggttaccgctacattgactactggggccagggaaccccggtcaccgtctcctca

SEQ ID NO: 524 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcaccctcgtacacttttggccaggggaccaagctggagatcaaa

SEQ ID NO: 525 - DNA, 372 bp, Homo sapiens
caggtgcagctggtggagtctgggggaggcgtggtccagcctgggaggtccctgagactctcctgtgcagcctctggattcaccttcagtagctatgctatgcactggggccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatggcggctcgggctggttattggttgggaactggttcgacccctggggccagggaaccctggtcaccgtctcctca

SEQ ID NO: 526 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcatcactctatatgtcttcggaactgggaccaaggtcaccgtccta

SEQ ID NO: 527 - DNA, 384 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaagggaatgactacggtgactacggggagtgggagctactgggctactttgactactggggccagggaaccctggtcaccgtctcctca

SEQ ID NO: 528 - DNA, 327 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatcgcagagtgttcggcggagggaccaagctgaccgtccta

SEQ ID NO: 529 - DNA, 378 bp, Homo sapiens
gaggtgcagctggtggagtctgggggaggcttggtacagcctggggggtccctgagactctcctgtgcagcctctggattcaacttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagggcccgagtgggatattgtagtagtacaagcagagaactggttcgacccctggggccagggaaccctggtcaccgtctcctca

SEQ ID NO: 530 - DNA, 327 bp, Homo sapiens
tcctatgagctgacacagccaccctcggtgtcagtgtccccaggacagacggccaggatcacctgctctggagatgcattgccaaagcaatatgtttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatcgaggggtgttcggcggagggaccaagctgaccgtccta

SEQ ID NO: 531 - DNA, 348 bp, Homo sapiens
gaggtgcagctggtggagtctgggggagtctcggtacagccaggggggtccctgagactctcctgtgcagcctcgggattttcctttaacacttacgacatgcactgggtccgccaaggcacgggaaaaggtctggagtgggtctcaggcattggcactgcgggcgatacatattactcagactccgtgaagggccggtgcaccatctccagagacaatgccaagaattccttgcatcttctagtgaagagcgtgagagccgcggacacggctgtgtattattgtgcaaggggggtgggtggaattatcgactactggggccagggaaccctggtcaccgtctcctca

SEQ ID NO: 532 - DNA, 330 bp, Homo sapiens
aactttgtgctgagtcagccccactctgtgtcggagtctccggggaagacggtaaccatctcctgcaccggcaacagtggcagtattgccaccaagtatgtacagtggttccagcagcgcccgggcagtgcccccaccactgtgatctatgaagataatcaaagaccctctggggtccctgatcggttctctggctccagcgacagctcctccaactctgcctctctcaccatctctggactgaagactgaagacgaggctcattactactgtcagtcttatcataacaggcgctgggtattcggcggagggaccaagttgaccgtccta

SEQ ID NO: 533 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagccgggggtgggagctactacaggggctttgactactggggccagggaaccctggtcaccgtctcctca

SEQ ID NO: 534 - DNA, 330 bp, Homo sapiens
cagtctgtgttgacgcagccgccctcagtgtctgcggccccaggacagaaggtcaccatctcctgctctggaagcaactccaacattgggaataattatgtatcctggtaccagcagctcccaggatcagcccccaaactcctcatttatgacaacgataagcgaccctcagggattcctgaccgattctctggctccaagtctggcacgtcagccaccctgggcatcaccggactccagactggggacgaggccgattattactgcggagcgtgggatagcagcctgactgctctggtattcggcggagggaccaagctgaccgtccta

SEQ ID NO: 535 - DNA, 363 bp, Homo sapiens
caggtgcaactggtggagtctgggggaggcgtggtccagcctgggaggtccctgagactctcctgtgcagcctctggattcaccttcagtagctatgctatgcactgggtccgccaggctccaggcaaggggctggagtgggtgacagttatatcatataatggaaggaataaatactacgcagactccgtgaagggccgattcaccatctccagagacaattccaagaacacgctgtatctgcaaatgaacagcctgagagctgaggacacggctgtgtattggtgtgcgagagaggggctgggcgcgatagtagtgggccttgactactggggccagggaaccctggtcatcgtctcctca

SEQ ID NO: 536 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagtaagcggccctcagggatccctgagcgattctctggctccaactctgggaacacagccactctgaccatcagcgggacccaggctatggatgaggctgactattactgtcaggcgtgggacagcaccactgtggtattcggcggagggaccaagctgaccgtccta

SEQ ID NO: 537 - DNA, 372 bp, Homo sapiens
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagataatttgggctacgatttttggagtggttcctggttcgacccctggggccagggaaccctggtcaccgtctcctca

SEQ ID NO: 538 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccctggacgttcggccaagggaccaaggtggaaatcaaa

SEQ ID NO: 539 - DNA, 372 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccatgtattactgtgcgagccatgtggtggtgattgctagtagctactggtgcttcgatctctggggccgtggcaccctggtcactgtctcctca

SEQ ID NO: 540 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcatcagcacttgggtgttcggcggagggaccaagctgaccgtccta

SEQ ID NO: 541 - DNA, 372 bp, Homo sapiens
caggtgcagctggtgcagtctggggctgaggtgaagaagcctgggtcctcggtgaaggtctcctgcaaggcttctggaggcaccttcaacagtaatagtatcagctgggtgcgacaggcccctggacaagggcttgagtggatgggaaggatcatccctatccttgatataacaatgtatgcacggaagttccagggcagagtcacgattagcgcggacaaatccacgggcacagcctacatggatctgagcagcctgagatctgaggacacggccgtatattactgtgcgacagatagagatgatagtagtggtgactactactacggtatggacgtctggggccaagggaccacggtcaccgtctcctca

SEQ ID NO: 542 - DNA, 321 bp, Homo sapiens
gacatccagatgacccagtctccatcctccctgtctgcatctgtaggagacagagtcaccatcacttgccgggcaagtctgagtattagcaactatttaaattggtatcagcagaaaccagggaaagcccctaacctcctgatctatgctgcatccactttgcaaagtggggtcccatcaaggttcagtggcagtggatctgggacagatttcactctcaccatcagcagtctgcaacctgaagattttgcaacttactactgtcaacagacttacattaccaggtggacgttcggccaagggaccaaggtggaaatcaaa

SEQ ID NO: 543 - DNA, 378 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgcgcgaggatgttgatagcagcagctggtactagcagggactactacggtatggacgtctggggccaagggaccacggtcaccgtctcctca

SEQ ID NO: 544 - DNA, 321 bp, Homo sapiens
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttacctcacactttcggcggagggaccaaggtggagatcaaa

SEQ ID NO: 545 - DNA, 363 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagaaccacagctatggtccgagtactactttgactactggggccagggaaccctggtcaccgtctcctca

SEQ ID NO: 546 - DNA, 321 bp, Homo sapiens
gacatccagatgacccagtctccatcctcactgtctgcatctgtaggagacagagtcaccatcacttgtcgggcgagtcagggtattagcagctggttagcctggtatcagcagaaaccagagaaagcccctaagtccctgatctatgctgcatccagtttgcaaagtggggtcccatcaaggttcagcggcagtggatctgggacagatttcactctcaccatcagcagcctgcagcctgaagattttgcaacttattactgccaacagtataatagttaccctcccaccttcggccaagggacacgactggagattaaa

SEQ ID NO: 547 - DNA, 369 bp, Homo sapiens
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagatctctcgggtggttcggggagttattaagctggttcgacccctggggccagggaaccctggtcaccgtctcctca

SEQ ID NO: 548 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctgggacgttcggccaagggaccaaggtggaaatcaaa

SEQ ID NO: 549 - DNA, 360 bp, Homo sapiens
gaggtgcagctggtggagtctgggggaggcttggtccagcctggggggtccctgagactctcctgtgcagcctctggaatcatcgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagaaggcttagtgggagctaccctagcctttgactactggggccagggaaccctggtcaccgtctcctca

SEQ ID NO: 550 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccggggacgttcggccaagggaccaaggtggaaatcaaa

SEQ ID NO: 551 - DNA, 366 bp, Homo sapiens
ggagtgcagctggtggagtctgggggagtcgtagtacagcctggggggtccctgagactctcctgtgcagcctctggattcagctttgatgattataccatgcactgggtccgtcaagctccggggaagggtctggagtgggtctctcttgttagttgggatggtggtaccacatactatacagactctgtgaagggccgattcaccatctccagagacaactccaaaaactccctgtatctgcaaatgaacagtctgagaactgaggacaccgccttgtatttctgtgcaaaagattctggtcgaatagtaccagctgctacatttgactactggggccagggaaccctggtcaccgtctcctca

SEQ ID NO: 552 - DNA, 321 bp, Homo sapiens
gacatccagatgacccagtcttcatcctcactgtctgcatctgtaggagacagagtcaccatcacttgtcgggcgagtcaggacattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtattatacttaccctctcactttcggcggagggaccaaggtggagatcaaa

SEQ ID NO: 553 - DNA, 390 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagcttcaccgtattactatgatagtagtggttattttttacccccgtactactttgactactggggccagggaaccctggtcaccgtctcctca

SEQ ID NO: 554 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgctcactttcggcggagggaccaaggtggagatcaaa

SEQ ID NO: 555 - DNA, 396 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagagatcttacagaagaaggggatttttggagtgcttcctcatatcgacggtactactactacggtatggacgtctggggccaagggaccacggtcaccgtctcctca

SEQ ID NO: 556 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagggggacccaggctatggatgaggctgactattactgtcaggcgtgggacagcagcactgcatacgtcttcggaactgggaccaaggtcaccgtccta

SEQ ID NO: 557 - DNA, 384 bp, Homo sapiens
caggtgcagctggtggagtctgggggaggcgtggtccagcctgggaggtccctgagactctcctgtgcagcctctggattcaccttcagtagctatgttatgcactgggtccgccaggctccaggcaaggggctggagtgggtggcacttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaggaggccacattagagtcgggagatattttgactggttaatctcctactttgactactggggccagggaaccctggtcaccgtctcctca

SEQ ID NO: 558 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttacctgacgttcggccaagggaccaaggtggaaatcaaa

SEQ ID NO: 559 - DNA, 360 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtttattactgtgcgagaggcctttattacgatatgggcgggggatttgactactggggccagggaaccctggtcaccgtctcctca

SEQ ID NO: 560 - DNA, 324 bp, Homo sapiens; identical to SEQ ID NO: 98

SEQ ID NO: 561 - DNA, 354 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatcaattatagtgggagcacctactacaacccgtccctcaagagtcgagtcaccatatcagtagacacgtccaagaaccagttctccctgaagctgagctctgtgaccgccgcggacacggccgtgtattactgtgcgagatatcatgactacggtgatgactactggggccagggaaccctggtcaccgtctcctca

SEQ ID NO: 562 - DNA, 333 bp, Homo sapiens
cagcttgtgctgactcaatcgccctctgcctctgcctccctgggagcctcggtcaagctcacctgcactctgagcagtgggcacagcaggtacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcattcaggtattcggcggagggaccaagctgaccgtccta

SEQ ID NO: 563 - DNA, 372 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagcatagcagcagctggccctaacacgctccagtactacggtatggacgtctggggccaagggaccacggtcaccgtctcctca

SEQ ID NO: 564 - DNA, 318 bp, Homo sapiens; identical to SEQ ID NO: 52

SEQ ID NO: 565 - DNA, 354 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccatattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtacgagggagccgtactactttgactactggggccagggaaccctggtcaccgtctcctca

SEQ ID NO: 566 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatcggtacacttttggccaggggaccaagctggagatcaaa

SEQ ID NO: 567 - DNA, 363 bp, Homo sapiens; identical to SEQ ID NO: 487

SEQ ID NO: 568 - DNA, 330 bp, Homo sapiens
gacatcgtgatgacccagtctccagactccctggctgtgtctctgggcgagagggccaccatcaactgcaagtccagccagagtgttttatacaggtccaacaataagaactgcttagcttggtaccagcagaaaccaggacggcctcctaaactgctcatttactgggcatctacccgggaatccggggtccctgaccgattcagtgtcagcgggtctgggacagatttcactctcaccatcagcagcctgcaggctgaagatgtggcagtttattactgtcagcaatattatacctttttcggccctggggccaaagtggatatcaaa

SEQ ID NO: 569 - DNA, 336 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgaggggatttgactactggggccagggaaccctggtcaccgtctcctca

SEQ ID NO: 570 - DNA, 324 bp, Homo sapiens
gaaattgtgttgacgcagtctccaggcaccctgtctttgtctccaggggaaagagccaccctctcctgcagggccagtcagagtgttagcatcatctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctctctgtggacgttcggccaagggaccaaggtggaaatcaaa

SEQ ID NO: 571 - DNA, 390 bp, Homo sapiens
gaagtgcagctggtggagtctgggggaggcttggtacagcctggcaggtccctgagactctcctgtgcagcctctggattcacctttcatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacttttggaagcagcagctggtacaggggggactcctactactactacggtatggacgtctggggccaagggaccacggtcaccgtctcctca

SEQ ID NO: 572 - DNA, 339 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactcagaggtatgtggtattcggcggagggaccaagctgaccgtccta

SEQ ID NO: 573 - DNA, 354 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcttcaaatggttcggggagttattattcggcgcgcagggaaccctggtcaccgtctcctca

SEQ ID NO: 574 - DNA, 330 bp, Homo sapiens; identical to SEQ ID NO: 286

SEQ ID NO: 575 - DNA, 375 bp, Homo sapiens
caggtgcagctggtgcaatctgggtctgagttgaagaagcctggggcctcagtgaaggtttcctgtaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcgtcctaaaggctgaggacactggcgtgtattactgtgcgagagaccatgagctaccaaatagcagcagctggttcgggcactttgagtactggggccagggaaccctggtcaccgtctcctca

SEQ ID NO: 576 - DNA, 324 bp, Homo sapiens; identical to SEQ ID NO: 438

SEQ ID NO: 577 - DNA, 369 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgaggaattgtggtggtgattgcgttgcaggggatggctttgactactggggccagggaaccctggtcaccgtctcctca

SEQ ID NO: 578 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtgccctcacgtggacgttcggccaagggaccaaggtggaaatcaaa

SEQ ID NO: 579 - DNA, 360 bp, Homo sapiens
caggtgcatcttgtggagtctgggggaggcgtggtccagcctgggaggtccctgagactctcctgtgcagcctctggatttgccctctccagctatgctatgcactgggtccgccagcctccaggcaaggggctggagtgggtggctcttatatcatatgatgggagtgtcaaaaagtacgcagactccgtgaagggccgaatcaccgtctccggagacaactccaggaacacgctgcatctgcaaatcaacagcctcagagccgacgacacggcggtctattactgtgtgaggggcggtgtcagtggcccaaattcatttgatctctggggccacgggacaatggtcaccgtctcttca

SEQ ID NO: 580 - DNA, 336 bp, Homo sapiens
gatgttgtgctgactcagtctccactctccctgcccgtcacccttggacagccggcctccatctcctgcaggtctagtcaaagcctcgaatacagtgttggaaacacctacgtgaattggtttcagcagaggccaggccaatctccaaggcgcctaatttataaggtttctaacagggactctggggtcccagacagattcagcggcagtgggtcaggcactgatttcacactgcaaatcagcagggtggaggctgacgatgttggcatttattactgcatgcaaggtacacactggccggtgacgttcggccaggggaccaaggtggaaatcaaa

SEQ ID NO: 581 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacaacctgagagctgaggacacggctgtgtattactgtgcgaagtcgggtagtgggagctacttgagtgcttttgatatctggggccaagggacaatggtcaccgtctcttca

SEQ ID NO: 582 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagtccctggacgttcggccaagggaccaaggtggaaatcaaa

SEQ ID NO: 583 - DNA, 345 bp, Homo sapiens; identical to SEQ ID NO: 461

SEQ ID NO: 584 - DNA, 321 bp, Homo sapiens
gacatccagatgacccagtctccatcctccctgtctgcatctgtaggagacagagtcaccatcacttgccggacaagtcagaccatttacaactatttaaattggtatcagcagaaaccagggaaagcccctaagttcctgatctatgctgcatccagttttcaaaatggggtcccatcaaggttcagtggcagtggatctgggacagatttcaccttcaccatcagcagtctgcaacctgaagattttgcaacttactactgtcaacagggttacagtacccctctcactttcggcggagggaccaaggtagagatcaaa

SEQ ID NO: 585 - DNA, 357 bp, Homo sapiens
caggtgcagctacaacagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaccccgtccctcaagagtcgagtcaccatatcagtagacacgtccaagaaccagttctccctgaagctgagctctgtgaccgccgcggacacggctgtgtattactgtgcgagaggatgggggaaccgtaagtacggtatggacgtctggggccaagagaccacggtcaccgtctcctca

SEQ ID NO: 586 - DNA, 324 bp, Homo sapiens
gaaattgtgttgacgcagtctccaggcaccctgtctttgtctccaggggaaagagccaccctctcctgcagggccagtctgagtgttagcagcaggtacttagcctggtaccagcagaaacctggccaggctcccaggctcctcatctatggtgcatccagcagggccactggcgtcccagacaggttcagtggcagtgggtctgggacagacttcactctcaccatcagcagactggagcctgaagattttgcagtgtattactgtcagcagcatggtagctcaccgctcactttcggcggagggaccaaggtggagatcaaa

SEQ ID NO: 587 - DNA, 363 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaaccaagatggaagtgacaaatactatgtggactctgtgaagggccgattcaccatctccagagacaacgccaagaactcactgtatctgcaaatgaacagcctgagagccgaggacacggctgtatattactgtgcgagagcccccgggtgggcagcagctcctacttttgactactggggccagggaaccctggtcaccgtctcctca

SEQ ID NO: 588 - DNA, 333 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaattcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacactttagtggtattcggcggagggaccaagctgaccgtccta

SEQ ID NO: 589 - DNA, 381 bp, Homo sapiens
caggtgcagctggtgcagtctggggctgaggtgaagaagcctgggtcctcggtgaaggtctcctgcaaggcttctggaggcaccttcagcagctatggtatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagggcggtctatgcagcaggagacgatgattactactactactacggtatggacgtctggggccaagggaccacggtcaccgtctcctca

SEQ ID NO: 590 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtggtggtgatatataaagacagtgacaggccctcagggatccctgagcgattctctggctccagctcagggacaacagtcacgttgaccatcagtggagtccaggcagaagacgaggctgactattactgtcaatcagcagacagcagtggtacttatcaggtcttcggaactgggaccaaggtctccgtccta

SEQ ID NO: 591 - DNA, 366 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggaaacacaaactatgcacagaagctccagggcagagtcaccatgaccacagacacatccacgagcacagcctacatggagctgaggagcctgagatctgacgacacggccgtgtattactgtgcgagagatcggggttatgcagcaacgttcggggtgtttgactactggggccagggaaccctggtcaccgtctcctca

SEQ ID NO: 592 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctctgctgcatccagtttgcaaagtggggtcccatcaaggttcagtggcagtggatctgggacagatttcactctcaccatcagcagtctgcaacctgaagattttgcaacttactactgtcaacagagttacagtaccgcattcactttcggccctgggaccaaagtggatatcaaa

SEQ ID NO: 593 - DNA, 366 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaccccagggtggcaactactactactacggtatggacgtctggggccaagggaccacggtcaccgtctcctca

SEQ ID NO: 594 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccccctcactttcggcggagggaccaaggtggagatcaaa

SEQ ID NO: 595 - DNA, 375 bp, Homo sapiens
caggtgcagctggtgcagtctggggctgaggtgaagaagcctgggtcctcggtgaaggtctcctgcaaggcttctggaggcaccttcagcaactatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaggttactacgaagcgaggcattactactactactacgctatggacgtctggggccaagggaccgcggtcaccgtctcctca

SEQ ID NO: 596 - DNA, 321 bp, Homo sapiens
gacatccagatgacccagtctccatcctccctgtctgcatctgtaggagacagagtcaccatcacttgccgggcaagtcagagcattagcagctatttaagttggtatcagcagaaaccagggaaagcccctaagctcctgatctatgctgcatccagtttgcaaagtggggtcccatcaaggttcagtggcagtggatctgggacagatttcactctcaccatcaccagtctgcaacctgaagattttgcaacttactactgtcaacagagttacagtacccctcgcacgttcggccaagggaccaaggtggaaatcaaa

SEQ ID NO: 597 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtgataaatactatgcagactccgtgaagggccgagtcaccatctccagagacaattccaagaacacgctgtatttgcaaatgaacagcctgagagttgaggacacggctgtgttttactgtgcgaaagacgattgtagtggtggtgtatgcttcccagactactggggccagggaaccctggtcaccgtctcctca

SEQ ID NO: 598 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtattcggccctcaggggtttctaatcgcttctctggctccaagtctggcaacacggcctccctgaccatctctgggctccaggctgaggacgaggctgcttattactgcagctcatatacaagcagcagcactctggtcttcggcggagggaccaagctgaccgtccta

SEQ ID NO: 599 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggatgtatagtgggagctatcgcggcggctttgactactggggccagggaaccctggtcaccgtctcctca

SEQ ID NO: 600 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgatcaccttcggccaagggacacgactggagattaaa

SEQ ID NO: 601 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaggtcagggggggggctactactacggtatggacgtctggggccaagggaccacggtcaccgtctcctca

SEQ ID NO: 602 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctttatgtcttcggaactgggaccaaggtcaccgtccta

SEQ ID NO: 603 - DNA, 372 bp, Homo sapiens
caggtgcagctgcaggagtcgggcccaggactggtgaagctttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagaagagactctgggcagcagctggtatgaaagctatattgactactggggccagggaaccctggtcaccgtctcctca

SEQ ID NO: 604 - DNA, 327 bp, Homo sapiens; identical to SEQ ID NO: 108

SEQ ID NO: 605 - DNA, 366 bp, Homo sapiens
gaggtgcagctggtggagtctgggggaggcttggtccagcctggggggtccctgagactctcctgtgcagcctctggattcaccatcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagaagaaggggagtgggaaaaagactactacggtatggacgtctggggccaagggaccacggtcaccgtctcctca

SEQ ID NO: 606 - DNA, 324 bp, Homo sapiens; identical to SEQ ID NO: 82

SEQ ID NO: 607 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagacctcttagtgggagctatagatccgcttttgatatctggggccaagggacaatggtcaccgtctcttca

SEQ ID NO: 608 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgaggacgttcggccaagggaccaaggtggaaatcaaa

SEQ ID NO: 609 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcttcaagtggaggttaccaaggcccgttcgacccctggggccagggaaccctggtcaccgtctcctca

SEQ ID NO: 610 - DNA, 336 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcctttatgtcttcggaactgggaccaaggtcaccgtccta

SEQ ID NO: 611 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcagatgatggaagtaataaatactacgcagactccgtgaagggccgattcaccatctccagagacaattccaagaacacgctgtatctgcaaatgaacagcctgagagctgaggacacggctgtgtattactgtgcgagagatatagtggctacgattcggaggcttttcgactactggggccagggaaccctggtcaccgtctcctca

SEQ ID NO: 612 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcccactttcggcggagggaccaaggtggagatcaaa

SEQ ID NO: 613 - DNA, 354 bp, Homo sapiens
caggtacacctggtggagtctgggggaggcgtggtccagcctgggaagtccctgagactctcctgtgcagcctcgggattcatcttcagttcctttggcatgcactgggtccgccagcctccaggcaaggggctggagtggctggcagttgtgtcatatgatggaagtgtcacaaaatattcagactcctttgagggccgattcaccatctccagagacaattccaagaataccctgtatctgcaaatggacagcctgagacctgaggatacggctgtatattactgtgcaaaaggccaggggacaaatcttcttcattattggggccagggaatcctggtcaccgtctcgtct

SEQ ID NO: 614 - DNA, 336 bp, Homo sapiens
gatgttgtgttgagtcagtctccactctccctgcccgtcacccttggacagccggcctccatctcctgcaggtctagtgaaagcctcgtttacactgatggagacacctacttacattggtttcaccagaggccaggccaatctccaaggcgcctaatttttaaggtttctcatcgggagtctggggtcccagacagaatcagcggcagtgggtcaggcactgatttcacactgaaaatcagcagggtggaggctgaggatgttggggtttattactgcatgcaaggtacacactggccattcactttcggccctgggaccaaagtggatatcaaa

SEQ ID NO: 615 - DNA, 372 bp, Homo sapiens
gaggtgcagctggtggagtctgggggaggcttggtccagcctggagggtccctgagactgtcgtgcacagcctctggattcaccctcagtgaccactacatggactgggtccgccaggctccagggaagggactggagtgggttgcccgtactcgaaacaaagttaacagttatagtacagaatatgccgcgtctgtgaaaggcagattctccatgtcaagagatgattcaaagaactcactctatctgcaaatgaccaggctgcaaaccgatgacacggccgtttactactgtgctagaagcctcatgattttgggggcccgcggggcctctgactattggggccagggaaccctggtcaccgtctcgtca

SEQ ID NO: 616 - DNA, 321 bp, Homo sapiens
gacatccagatgacccagtctccttccaccctgtctgcatctgcaggagacagagtcaccatcacttgccgggccagtcagaatattgatagctggttggcctggtatcagcagcatccagggaaagcccctaacctcctgatctataaggcgtcttttttacaaagtggggtcccatcacggttcagcggcagtgggtctgggacagaattcactctcaccatcagcagcctgcagcctgatgattttgcaacgtattactgccaacaatataatagttatccagtcaccttcggccaagggacacggctggagattaaa

SEQ ID NO: 617 - DNA, 372 bp, Homo sapiens
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagacctcggcgtagcagtgactctacaccccgcggactttgactactggggccagggaaccctggtcaccgtctcctca

SEQ ID NO: 618 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatgataacagcaatcggccctcaggggtccctgaccgattctctggctccaagtctggcacctcagcctccctggccatcactgggctccaggctgaggatgaggctgattattactgccagtcctatgacagcagcctgagtgctgtggtattcggcggagggaccaagctgaccgtccta

SEQ ID NO: 619 - DNA, 357 bp, Homo sapiens
caggtgcagctggtggagtctgggggaggcgtggtccagcctgggaggtccctgagactctcctgtgcagcctctggattcaccttcagtaattatgctatgcactgggtccgccaggctccaggcaaggggctggagtgggtggcagttatttcatatgatggaagtcatgaatactacgcagactccgtgaagggccgattcaccatctccagagacaattccaagaacacgctgtatctgcaaatgaacagcctgagagctgaggacacggctatttattactgtgcgagaggtgggggcggatataaattctttgactactggggccagggaaccctggtcaccgtctcctca

SEQ ID NO: 620 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccctcgtacacttttggccaggggaccaagctggagatcaaa

SEQ ID NO: 621 - DNA, 375 bp, Homo sapiens
gaagtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatataggatatagcagcaccaccaccgaggtcggctggttcgacccctggggccagggaaccctggtcaccgtctcctca

SEQ ID NO: 622 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggagggaccaaggtggagatcaaa

SEQ ID NO: 623 - DNA, 363 bp, Homo sapiens; identical to SEQ ID NO: 609

SEQ ID NO: 624 - DNA, 312 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcagccctttcggccctgggaccaaagtggatatcaaa

SEQ ID NO: 625 - DNA, 360 bp, Homo sapiens; identical to SEQ ID NO: 505

SEQ ID NO: 626 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtgatattcggcggagggaccaagctgaccgtccta

SEQ ID NO: 627 - DNA, 351 bp, Homo sapiens
gaggtgcagctggtggagtctgggggaggcttggtccagcctggggggtccctgagactctcctgtgcagcctctggattcacctttagtacctattggatgacctgggtccgccaggctccagggaaggggctggagtgggtggccaacataaagcacgatggaagtgggaaataccatgtggactctgtgaagggccgattcaccatctccagagacaacgccaagaactcactgtatctgcaaatgaacagcctgagagccgaggacacggctgtatattactgtacgagagatgaaggtggctggtacgactactggggccagggaaccctggtcaccgtctcctca

SEQ ID NO: 628 - DNA, 333 bp, Homo sapiens
cagtctgccctgactcagcctgcctccgtgtctgggtctcctggacagtcgatcaccatctcctgcactggaaccagcagtgatgttgggagttataaccctgtctcctggtaccaacaacacccaggcaaagcccccaaagtcatgatttatgagggcagtaagcggccctcaggggtttctaatcgcttctctggctccaagtctggcaacacggcctccctgacaatctctgggctccaggctgaggacgaggctgattattactgctgctcatatgcacgtagtagcactttcgtggtcttcggcggagggaccaagctgaccgtccta

SEQ ID NO: 629 - DNA, 360 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcccagggtgggaactactactactttgactactggggccagggaaccctggtcaccgtctcctca

SEQ ID NO: 630 - DNA, 318 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactctttcactttcggccctgggaccaaagtggatatcaaa

SEQ ID NO: 631 - DNA, 414 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatgcttttcgagtccagtattacgatttttggagtggttattataccggtatagggtatgactactactactacggtatggacgtctggggccaagggaccacggtcaccgtctcctca

SEQ ID NO: 632 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactccttatgtcttcggaactgggaccaaggtcaccgtccta

SEQ ID NO: 633 - DNA, 366 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaaccgatcgatactatggttcaggggcccactttgactactggggccagggaaccctggtcaccgtctcctca

SEQ ID NO: 634 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccgggaacgttcggccaagggaccaaggtggaaatcaaa

SEQ ID NO: 635 - DNA, 390 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacgacccgactagattatgattacatttgggggagttatcgtctctacggtatggacgtctggggccaagggaccacggtcaccgtctcctca

SEQ ID NO: 636 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactttggacgttcggccaagggaccaaggtggaaatcaaa

SEQ ID NO: 637 - DNA, 363 bp, Homo sapiens; identical to SEQ ID NO: 533

SEQ ID NO: 638 - DNA, 318 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctactttcggccctgggaccaaagtggatatcaaa

SEQ ID NO: 639 - DNA, 366 bp, Homo sapiens
cagctgccgctgcaggagtcgggcccaggactggtgaagccttcggagaccctgtccctcacctgcactgtctctggtggctccatcagcagtagcagttactactggggctggatccgccagcccccagggaaggggctggagtggattgggagtatctattatagtgggagcaccttctacaacccgtccctcaagagtcgagtcaccatatccggagacacgtccaagaaccagttctccctgaaggtgacctctgtgaccgccgcggacacggctgtatattactgtgcgagagggtctggaagcagtggctggtatgcttttgatatctggggccaagggacaatggtcaccgtctcttca

SEQ ID NO: 640 - DNA, 330 bp, Homo sapiens
cagtctgccctgactcagcctgcctccgtgtctgggtctcctggacagtcgatcaccatctcctgcactggaaccagcagtgactttggtggttataactatgtctcctggtaccaacaacacccagacaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaaccagcagcacttgggtgttcggtggagggaccaagctgaccgtccta

SEQ ID NO: 641 - DNA, 393 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatctgtattactatgatagtagtggttattactttaatccacgcccgatgtggtacttcgatctctggggccgtggcaccctggtcactgtctcctca

SEQ ID NO: 642 - DNA, 318 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctttcttcggccaagggacacgactggagattaaa

SEQ ID NO: 643 - DNA, 363 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcttccgtattacgcaactacaactggttcgacccctggggccagggaaccctggtcaccgtctcctca

SEQ ID NO: 644 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtccta

SEQ ID NO: 645 - DNA, 372 bp, Homo sapiens
gaggtgcagctggtggagtctggaggagacttgatccagcctggggggtccctgagactctcctgtgcagcctctgggttcaccgtcagagacaattacatgagttgggtccgccaggctccagggaaggggctggagtgggtctcaattatttttaaaagtggaaccaaatactacgcagactccgtgaagggccgattcaccatctccagagacaattccaagaacacactctatcttcaaatgaacagcctgagagccgaagactcggccgtttattactgttcaagagggtcccccccttcttcggggactttgtattacaaaccatttgaccaatggggccagggaaccctggtcatcgtctcctca

SEQ ID NO: 646 - DNA, 321 bp, Homo sapiens
gacatccagatgacccagtctccttccaccctgtctgcatctctaggagacagagtcaccatcacttgccgggccagtcagaatattagcagctggttgacctggtatcagcagaaaccagggaaagcccctaaactcctgatctataaggcgtctagtttagagagtggggtcccaccaaggttcagcggcagtggatctggcacagaattcactctcaccatcagcggcctgcagactgatgattttgcaacttattactgcctacaatatgctacttactggtacacttttggccaggggaccaagctggagatcaaa

SEQ ID NO: 647 - DNA, 354 bp, Homo sapiens
cagatcaccttgaaggaatctggtccaacgctggtgaaacccacagagaccctcacgctgacctgcaccttctctggcttctctctcactagaactggagaggctgcgggctggatccgtcaggccccaggaagggccctggagtgggtaacagtcattttttgggatgatgataagcgctacagcccatctcttaagaacagagtcagtgtcaccaaggacacctccaaaagtcgggtggtccttagaatgacccacgtggaccctgtggacacagccacatatttctgttgggccatggggggacctggtaatgagtactttggccagggaaccctggtcgccgtctcctca

SEQ ID NO: 648 - DNA, 336 bp, Homo sapiens
cagtctgtgctgacccagccgccctcagtgtctggggccccggggcagagggtcaccgtctcctgcactgggaccagttccagcatcgggccttattctgatgtgcactggtatcagcacatttcaggaaaagcccccaggctcctcatctttggaaccagcaatcggccctcaggggtccctgaccgattctctggctccaagtctggcacctcagcctccctggtcatcgctgggctccaggctgaggatgaggctgattattactgccagtcttatgacagcagtctgggtgagatttatgtcttcggaactgggaccacggtcaccgtccta

SEQ ID NO: 649 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaaataataaatactacgcagactccgtgaagggccgattcaccgtctccagagacaattccaagaacacgctgtatctgcaaatgaacagcctgagagctgaggacacggctgtgtattactgtgcgagaccaagaggtggtacctacaacaactggttcgacccctggggccagggaaccctggtcaccgtctcctca

SEQ ID NO: 650 - DNA, 324 bp, Homo sapiens; identical to SEQ ID NO: 170

SEQ ID NO: 651 - DNA, 375 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatgatgcgtggggatttttggagtggttagactcatctatggacgtctggggccaagggaccacggtcaccgtctcctca

SEQ ID NO: 652 - DNA, 333 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcggacgttcggccaagggaccaaggtggaaatcaaa

SEQ ID NO: 653 - DNA, 363 bp, Homo sapiens
caggtgcagctggtggagtctgggggaggcgtggtccagcctgggaggtccctgagactctcctgtgcagcctctggattcaccttcgcaacctatgctatgcactgggtccgccaggctccaggcaaggggctggagtgggtggcacttatatcacatgatggaagtaataaacattacgcagactccgtgaagggccgattcaccatctccagagacaattccaagaaaacactgtatctgcaaatgaacagcctgagagctgagggcacggccatatattactgtgcgagagagagtttagaagcagctgcccccccctttgactactggggccagggaaccctggtcaccgtctcctca

SEQ ID NO: 654 - DNA, 321 bp, Homo sapiens; identical to SEQ ID NO: 402

SEQ ID NO: 655 - DNA, 366 bp, Homo sapiens
caggtgcagctggtacaatctgggtctgagttgaagaagcctggggcctcagtgaagctttcctgccaggcttctgggtacaccttcactaaccatgctatgaattgggtgcgccaggcccctggacaggggcttgagtggatgggatggatcaacaccaacactgggaacccaacatatgcccagggcttcacaggacgctttgtcttctctttggacgcctctgtcagcacggcatatctgcacatcagcatcctagagcctgaggacactgccttttatttctgtgcgagagcgtctgcgcgtccgggtgttgcaacaaacttagacttctggggccagggaaccctggtcgtcgtctcctca

SEQ ID NO: 656 - DNA, 321 bp, Homo sapiens
gacatccagatgacccagtctccatcctccctgtctgcatctgtaggagacagagtcaccatcacttgccgggcaagtcagaatattgacaactatttaaattggtatcagcagaaaccaggggaagcccctaatctcctgatctatgctgcgtccagattgcatagtggggtcccatcaaggttcagtggcagtggatctgggacagagtttactctcatcatcagcagtctacaacctgaagatcttgcaacttattactgtcaacagagttacagtaatcctctcactttcgcccctgggaccaaagtggatatcaga

SEQ ID NO: 657 - DNA, 378 bp, Homo sapiens
cagctgcagctgcaggagtcgggcccaggactagtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagcgaaaaagtggatttttggagtgggggaccctactacggtatggacgtctggggccaagggaccacggtcaccgtctcctca

SEQ ID NO: 658 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttcccggttacttttggccaggggaccaagctggagatcaaa

SEQ ID NO: 659 - DNA, 366 bp, Homo sapiens
cagatcaccttgaaggagtctggtccaacgctggtgaaacccacagagaccctcacgctgacctgcgatttctctgggttctcactcaacaatagtgatgtgggtgtggcctggatccgtcagcccccaggaaaggccctggagtggcttgcactcattttttgggatgatgataagcgctacaacccatctctgaaaagcagactcaccgtcaccaaggacacctccaaaaaccaggtggtccttacaatgaccaacatggaccctgtggacacagccacatattattgtgcacgcagacgcgtcaccacaaggtacttttggttcgacccctggggccagggaaccctggtcaccgtctccgca

SEQ ID NO: 660 - DNA, 324 bp, Homo sapiens
gaaattgtgttgacgcagtctccaggcaccctgtctttgtctccaggacaaagagccaccctctcctgcagggccagtcagagtgttagcagcagctacttagcctggtaccagcagaaacctggccaggctcccaggctcctcatctatggtacatccaacagggccactggtatcccagacaggttcagtggcagtgggtctgggacagacttcacgctcaccatcagcagactggagcctgaagattttgcaatgtattactgtctacagtatggttggtcactgtacacttttggccaggggaccaagctggagatcaaa

SEQ ID NO: 661 - protein, 115 aa, Homo sapiens
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAAGYGSIDYWGQGTLVTVSS

SEQ ID NO: 662 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKLEIK

SEQ ID NO: 663 - protein, 128 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDLLSWKLYCSGGSCPQMDVWGQGTTVTVSS

SEQ ID NO: 664 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPQTFGQGTKLEIK

SEQ ID NO: 665 - protein, 123 aa, Homo sapiens
EVQLVESGGGLVQPGRSLRLSCAASGFTFDYYAMHWVRQAPGKGLEWVSGISWNSGTIGYADSVKGRFTISRDNAKNSLYLQMNSLRAEDTALYYCAKDSRPSGRYYYGMDVWGQGTTVTVSS

SEQ ID NO: 666 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPLTFGGGTKVEIK

SEQ ID NO: 667 - protein, 134 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDEAYYDILTGYINAPKNYYYYGMDVWGQGTTVTVSS

SEQ ID NO: 668 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPFTFGPGTKVDIK

SEQ ID NO: 669 - protein, 127 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGGELLWFGELDYYGMDVWGQGTTVTVSS

SEQ ID NO: 670 - protein, 107 aa, Homo sapiens
SYELTQPSSVSVSPGQTARITCSGDVLAKKYARWFQQKPGQAPVLVIYKDSERPSGIPERFSGSSSGTTVTLTISGAQVEDEADYYCYSAADNNRGVFGGGTKLTVL

SEQ ID NO: 671 - protein, 124 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSDDTAVYYCTTDLAFTIFGGRRGFDPWGQGTLVTVSS

SEQ ID NO: 672 - protein, 105 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYDFGQGTRLEIK

SEQ ID NO: 673 - protein, 120 aa, Homo sapiens
QVHLVESGGGVVQPGRSLRLSCAASGFTLTSYAMHWVRQAPGKGLEWVALISYDGSVKKYAESVKGRITVSGDNSRNTLHLQINTLRADDTAVYYCVRGGVSGPNSFDLWGQGTMVTVSS

SEQ ID NO: 674 - protein, 112 aa, Homo sapiens
DVVMTQSPLSLPVTLGQPASISCRSSQSLEYSDGNTYVNWFQQRPGQSPRRLIYQVSNRASGVPDRFSGSGSGTDFTLQISRVEAEDVGIYYCMQGTHWPVTFGQGTKVEIK

SEQ ID NO: 675 - protein, 118 aa, Homo sapiens
EVQLVQSGAEVKKPGATVKVSCKFSGDTFSHYYIHWVQQAPGKGLEWMGLVDPQDGESEYAQKFQGKVTITADTSIDTSYLEVTSLRFDDTAFYFCATRGMSGAFDRWGQGTLVTVSS

SEQ ID NO: 676 - protein, 118 aa, Homo sapiens
DIVMTQSPDSLAVSLGERATINCKSSQSILSTSNNKNYLAWYQQKPGQPPKLLIYWASTRESGVPDRFSGGGSGTDFTLTISSLQAEDVAVYYCQQYYRTAYTTPIYTFGQGTKLEIK

SEQ ID NO: 677 - protein, 120 aa, Homo sapiens
QVQLVESGGGVVQPGRSLRLSCAASGFNLSNYAMHWVRQPSGKGLEWVSLISYDGSIKYYTDSVKGRFTVSGDNSKNTLFLQMNSLRPDDSALYYCVRGGVSGPNSFDMWGQGTTVTVSS

SEQ ID NO: 678 - protein, 112 aa, Homo sapiens
DVVMTQSPLSLPVTLGQPASISCRSSQSLVYSDGNTYVNWFQQRPGQSPRRLIYQVSIRASGVPDRFSGSGSGTDFALKISRVEAEDVGVYYCMQGTHWPVTFGQGTKVEIK

SEQ ID NO: 679 - protein, 116 aa, Homo sapiens
EVHLVQSGAEMKKPGATVKISCKVSGNTFIDHYIQWVQQAPGKGFEWMGLVDPEDGETIYAEKFQGRVTITADTSRDTAYMELSSLKSEDTAVYYCGTHGDYLDYWGQGTLVTVSS

SEQ ID NO: 680 - protein, 106 aa, Homo sapiens
FYELTQPSSVSVSPGQTALITCSGDVVAKKYARWFQQKAGQAPVLVIYKDTERPSGIPERISGSSSGTTVTLTISGAQVEDEADYYCYSATDNNLVFGGGTKVTVL

SEQ ID NO: 681 - protein, 122 aa, Homo sapiens
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCARELVGGLLGTIDYWGQGTLVTVSS

SEQ ID NO: 682 - protein, 107 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPYTFGQGTKLEIK

SEQ ID NO: 683 - protein, 131 aa, Homo sapiens
QLQLQESGPGLVKPSETLSLTCTVSGGSISSSSYYWGWIRQPPGKGLEWIGNIYYSGSTYYNPSLKSRVTISVDTSKNQFSLKLSSVTAADTAVYYCAGEELDIVATIYSSRYYYYGMDVWGQGTTVTVSS

SEQ ID NO: 684 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSTSTLVFGGGTKLTVL

SEQ ID NO: 685 - protein, 123 aa, Homo sapiens
QVQLVQSGAEVKRPGTSVKVSCKTSGYTFTDHFIHWVRQAPGRRLEWMGWINPNSGGTNYAQNFQGRVTMTRDTSITTAYMDLTRLTSDDTAIYYCAREAAYGSGNLNWFDPWGQGTRVTVSS

SEQ ID NO: 686 - protein, 110 aa, Homo sapiens
NFMLTQPHSVSESPGKTVTISCTGSSGSIAANYVHWYQQRPGSAPRTVIYEDNQRPSGVPDRFSGSIDSSSNSASLTISGLKTEDEADYYCQSYDGDSWVFGGGTKLTVL

SEQ ID NO: 687 - protein, 124 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREGWDDSSGYYYSFDYWGQGTLVTVSS

SEQ ID NO: 688 - protein, 110 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPKLTFGGGTKVEIK

SEQ ID NO: 689 - protein, 126 aa, Homo sapiens
QVQLVQSGAEVKKPGASVKVSCKASGYTFTTYYMHWVRQAPGQGLEWMGIINPSGGSASYAQKFQGRVTMTRDTSTSTVYMELSSLRSEDTAVYYCARDHTLVNGDYEYYYGMDVWGQGTTVTVSS

SEQ ID NO: 690 - protein, 108 aa, Homo sapiens
SYELTQPPSVSVSPGQTARITCSGDALPKQYAYWYQQKPGQAPVSVIYKDSERPSGIPERISGSSSGTTVTLTISGVQAEDEADYYCQSADSSGTYLVFGGGTKLTVL

SEQ ID NO: 691 - protein, 127 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAPGYYDSSAPQPINWFDPWGQGTLVTVSS

SEQ ID NO: 692 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTLVFGGGTKLTVL

SEQ ID NO: 693 - protein, 124 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDSESDSSGWLHYFDYWGQGTLVTVSS

SEQ ID NO: 694 - protein, 105 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSTVVFGGGTKLTVL

SEQ ID NO: 695 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARARGGSYRNAFDIWGQGTMVTVSS

SEQ ID NO: 696 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSRYTFGQGTKLEIK

SEQ ID NO: 697 - protein, 121 aa, Homo sapiens
QVQLQESGPGLVKPSQTLSLTCTVSGDSISSGGYYWSWIRQHPGKGLEWIGYIYYSGSAYYNPSLKSRVTISLDTSKNQFSLKLSSVTAADTAVYYCARDSVAGFSIFDYWGQGTLVTVSS

SEQ ID NO: 698 - protein, 108 aa, Homo sapiens
SSELTQDPAVSVALGQTVRITCQGDSLRSYYASWYQQKPGQAPVRVIYGKNNRPSGIPDRFSGSSSGNTASLTITGAQAEDEADYYCNSWDSSGNHVVFGGGTKLTVL

SEQ ID NO: 699 - protein, 121 aa, Homo sapiens
QVQLVESGGGVVQPGRSLRLSCAASGFTFSSYAMHWVRQAPGKGLEWVAVISYDGSNTYYADSVKGRFTISRDNSKNTLYLQMNSLRAEDTAVYYCARPYSGSYFNWFDPWGQGTLVTVSS

SEQ ID NO: 700 - protein, 113 aa, Homo sapiens
DIVMTQSPDSLAVSLGERATINCKSSQSVLYSSNNKNYLAWYQQKPGQPPKLLTYWASTRESGVPDRFSGSGSGTDFTLTISSLQAEDVAVYYCQQYYSTPLTFGGGTKVEIK

SEQ ID NO: 701 - protein, 135 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDHSNADPYYDFWSGYYTRTYYYGMDVWGQGTTVTVSS

SEQ ID NO: 702 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGPGTKVDIK

SEQ ID NO: 703 - protein, 124 aa, Homo sapiens
EVQLLESGGGLVQPGGSLRLSCAASGFTFSSYAMSWVRQAPGKGLEWVSTISGSGGNTYYADSVKGRFTISRDNSKNTLYLQMNSLRAEDTAVYYCAKDLFQGLYYGSGEFDYWGQGTLVTVSS

SEQ ID NO: 704 - protein, 110 aa, Homo sapiens
QSALTQPASVSGSPGQSITISCTGTSSDVGAYNYVSWYQQHPGKAPKLMIYGVSNRPSGVSNRFSGSKSGNTASLTISGLQAEDEADYYCSSYTSSSTRVFGTGTKVTVL

SEQ ID NO: 705 - protein, 124 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDQKWELLHYYYGMDVWGQGTTVTVSS

SEQ ID NO: 706 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 707 - protein, 128 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKNRVEDDYIWGSYRWNYFDYWGQGTLVTVSS

SEQ ID NO: 708 - protein, 111 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTHVVFGGGTKLTVL

SEQ ID NO: 709 - protein, 121 aa, Homo sapiens
EVQLVESGGGLVQPGGSLRLSCAASGFTFSGHSMNWVRQSPGTGLEWVSYITVSSSTIYYADSVKGRFTISRDNAKSSLFLQMNSLRDEDTAVYYCARDGAARPYWYFDLWGRGTLVTVSS

SEQ ID NO: 710 - protein, 113 aa, Homo sapiens
DIVMTQSPDSLAVSLGERATINCKSSQSVLYTSNNKNYLAWYQHKPGQPPKLLIYWASTRESGVPDRFSGSGSGTDFTLTISSLQAEDVAVYYCQQYYATPFAFGPGTKVDIK

SEQ ID NO: 711 - protein, 119 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCALMGYRAVAGYDYWGQGTLVTVSS

SEQ ID NO: 712 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 713 - protein, 123 aa, Homo sapiens
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARTSGYSSSWPSFDYWGQGTLVTVSS

SEQ ID NO: 714 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQWTFGQGTKVEIK

SEQ ID NO: 715 - protein, 126 aa, Homo sapiens
QVQLQESGPGLVKPSGTLSLTCAVSGGSISSSNWWSWVRQPPGKGLEWIGEIYHSGSTNYNPSLKSRVTISVDNSKNQFSLKLSSVTAADTAVYYCARESVAAAGISYYYYGMDVWGQGTTVTVSS

SEQ ID NO: 716 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 717 - protein, 118 aa, Homo sapiens
QVHLVESGGGVVQPGKSLRLSCAGSGFIFSDFGMHWVRQSPGKGLEWVAVVSYDGSVTKYSDSFEGRFTISRDNSKNTLYLQMDSLRPDDTAIYYCAKGQGANLLHYWGKGILVTVSS

SEQ ID NO: 718 - protein, 112 aa, Homo sapiens
DVVLTQSPLSLPVTLGQPASISCRSSESLVYTDGDTYLHWFHQRPGQSPRRLIYKVSNRDSGVPDRFSGSGSGTDFTLKISRVEAEDVGVYYCMQGTHWPFTFGPGTKVDIK

SEQ ID NO: 719 - protein, 123 aa, Homo sapiens
QLQLQESGPGLVKPSETLSLTCTVSGGSISSSSYYWGWIRQPPGKGLEWIGSIFYSGSTYYNPSLKSRVTIFVDTSKNQFSLKLSSVTAADTAVYYCARFDYQVVDLTGFDYWGQGTLVTVSS

SEQ ID NO: 720 - protein, 107 aa, Homo sapiens
DIQMTQSPSSLSASVGDRVTITCRASQGIRNDLGWYQQKPGKAPKRLIYAASSLQSGVPSRFSGSGSGTEFTLTIRSLQPEDFATYYCLQYNSYPLTFGGGTKVEIK

SEQ ID NO: 721 - protein, 130 aa, Homo sapiens
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARGANRDYDILTGYYSYYYYGMDVWGQGTTVTVSS

SEQ ID NO: 722 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPWTFGQGTKVEIK

SEQ ID NO: 723 - protein, 126 aa, Homo sapiens
QVQLVQSGSELKKPGASVKVSCKASGYTFTTYAMNWVRQAPGQGLEWMGWINTNTGTPTYAQGFTGRFVFSLDTSVSTAYLQISSLKADDTAVYYCARDLYSSSQENYYNYYMDVWGKGTTVTVSS

SEQ ID NO: 724 - protein, 107 aa, Homo sapiens
DIQMTQSPSSLSASVGDRVTITCRASQSISSYLNWYQQKPGKAPNLLIYAASSLQSGVPSRFSGSGSGTAFTLTISSLQPEDFVIYYCQQSFSTPYTFGQGTKLEIK

SEQ ID NO: 725 - protein, 125 aa, Homo sapiens
QVHLVQSGAEVKKPGASVKVSCAASGYTFNNYGVSWVRQAPGQGLEWMGWISASNGNTKYAQNLQGRVTMTTDTSTSTAYMELRSLRSDDTAVYYCARDLVGPTAPNYYYGMDVWGQGTAVTVSS

SEQ ID NO: 726 - protein, 111 aa, Homo sapiens
QSVLTQPPSVSGAPGQRVTISCTGSSSSIGAGYDVHWYQQLPGTAPKLLIYANSNRPSGVPDRLSGSKSGTSASLAITGLQAEDEADYYCQSYDSSLSGYVFGTGTKVTVL

SEQ ID NO: 727 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASGGSYFGGMDVWGQGTTVTVSS

SEQ ID NO: 728 - protein, 111 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVL

SEQ ID NO: 729 - protein, 116 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLQGGGGPWGQGTLVTVSS

SEQ ID NO: 730 - protein, 107 aa, Homo sapiens
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKVEIK

SEQ ID NO: 731 - protein, 118 aa, Homo sapiens
QVQLQESGPGLVKPSGTLSLTCVVSGVSISSSNWWSWVRQPPGKGLEWIGEIYYSGTTNYNPSLKSRVTISVDKSKNQFSLKLNSVTDADTAVYYCARKWELLAFDIWGQGTMVTVSS

SEQ ID NO: 732 - protein, 112 aa, Homo sapiens
DIVMTQSPLSLPVTPGEPASISCRSRQSLLHRNGYNSLDWYLQKPGQSPQLLIYLGSNRASGVPDRFSGSGSGTDFTLKISRVEAEDVGVYYCMQALQTPYTFGQGTKLEIK

SEQ ID NO: 733 - protein, 117 aa, Homo sapiens
EVQLVESGGGLVQPGGSLRLSCAASGFTVSSNYMNWVRQAPGKGLEWVSVIYSGGSTYYADSVKGRFTISRDNSKNTLYLQMNSLRAEDTAVYYCARDLGPSGMDVWGQGTTVTVSS

SEQ ID NO: 734 - protein, 106 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPLFGGGTKVEIK

SEQ ID NO: 735 - protein, 124 aa, Homo sapiens
QVQLQESGPGLVKPSQTLSLTCTVSGGSISSSDYYWSWIRQPPGKGLEWIGYIYYSGSTYYNPSLKSRVTISVDTSKNQFSLKLSSVTAADTAVYYCARVVGYCSSTSCYVDYWGQGTLVTVSS

SEQ ID NO: 736 - protein, 109 aa, Homo sapiens
EIVLTQSPATLSLSPGERVTLSCRASQSVSSYLAWYQQKPGQAPRLLIYDASNRATGIPARFSGSGSGTDFTLTISSLEPEDFAVYYCQQRSNWPPGLTFGGGTKVEIK

SEQ ID NO: 737 - protein, 119 aa, Homo sapiens
EVQLVESGGGLVQPGGSLRLSCAGSGFTLSNYWMTWVRQAPGKGLEWVANINQDASRKYYGDSVKGRFSVSRDNAKNSLYLQMNSLTAEDTGFYYCVREELPSTPGSTWGQGTLVTVSS

SEQ ID NO: 738 - protein, 110 aa, Homo sapiens
QSALTQPASVSGSPGQSITISCTGTSSDIGGYNHVSWYQQHPGKAPKLMIYGVSNRPSGVSDRFSGSKSDNTASLTISGLQAEDEADYYCSSPTSRGNKVFGTGTKVTVL

SEQ ID NO: 739 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSFRGGYYYGMDVWGQGTTVTVSS

SEQ ID NO: 740 - protein, 108 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPLFTFGPGTKVDIK

SEQ ID NO: 741 - protein, 122 aa, Homo sapiens
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCAREEGEWEKDYYGMDVWGQGTTVTVSS

SEQ ID NO: 742 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYRVFGGGTKLTVL

SEQ ID NO: 743 - protein, 125 aa, Homo sapiens
QVQLVQSGTEVKKPGASVKVSCKASGYTFTGYYMHWVRQAPGQGLEWMGWINPISGGTNYAQKFQGRVTMTRDTSISTAYMELSRLRSDDTAVYYCAREGAGYSSSWYYYGMDVWGRGTTVTVSS

SEQ ID NO: 744 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPWTFGQGTKVEIK

SEQ ID NO: 745 - protein, 121 aa, Homo sapiens
QVQLVESGGGVVQPGRSLTLSCAASGFTFSSYAMHWVRQAPGKGLEWVALISYDGNNKYYADSVKGRFTFSRDNSKNTLYLQMNSLRAEDTAVYYCARTNSGSYRTAFDYWGQGTLVTVSS

SEQ ID NO: 746 - protein, 106 aa, Homo sapiens
DIQMTQSPSTLSASVGDRVTITCRASQSISIWLAWYQQKPGKAPKLLIYKASSLESGVPSRFSGSGSGTEFTLTISSLQPDDFATYYCQQYNSLWTFGQGTKVEIK

SEQ ID NO: 747 - protein, 124 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAFCGGDCYPPDALDIWGQGTMVTVSS

SEQ ID NO: 748 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 749 - protein, 128 aa, Homo sapiens
QVQLVQSGAEVRKPGASVKVSCKVSGYTLSELSMHWVRQAPGKGLEWMGGFDPEDGERMYAQKFQGRVTMTEDTSTDTAYMELSSLRSEDTAIYYCTTDLSYLWSGKLEPDYWYFALWGRGTLVTVSS

SEQ ID NO: 750 - protein, 113 aa, Homo sapiens
DIVMTQSPDSLAVSLGERATINCKSSQSVLYSSNNKNYLAWYQQKPGQAPKLLISWASTRESGVPDRFSGSGSGTEFTLTISSLQAEDVAVYYCQQYYGTPLTFGQGTKLEIR

SEQ ID NO: 751 - protein, 120 aa, Homo sapiens
QVQLVESGGGVVQPGRSLRLSCAASGFNLSSYAMHWVRQASGKGLEWVSLISYDGSIKYYADSVKGRFTVSGDNSKNMLFLQMNSLRADDSALYYCVRGGVSGPNAFDIWGQGTTVTVSS

SEQ ID NO: 752 - protein, 112 aa, Homo sapiens
DVVMTQSPLSLPVTLGQPASISCRSSQSLVYSDGNTYVNWFQQRPGQSPRRLIYKVSNRDSGVPDRFSGSGSGTDFALKISRVEAEDVGVYYCMQGTHWPVTFGQGTKVEIK

SEQ ID NO: 753 - protein, 115 aa, Homo sapiens
EVQLLESGGGLVQPGGSLRLSCAASGFTFSTYAMSWVRQAPGKGLEWVSAISGSGGSTYYADSVKGRFTISRDNSKNTLYLQMNSLRAEDTAVYYCASGYSPDYWGQGTLVTVSS

SEQ ID NO: 754 - protein, 107 aa, Homo sapiens; identical to SEQ ID NO: 730

SEQ ID NO: 755 - protein, 131 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREQTSYDYVWGTLGAYYYYGMDVWGQGTTVTVSS

SEQ ID NO: 756 - protein, 108 aa, Homo sapiens
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHLVFGGGTKLTVL

SEQ ID NO: 757 - protein, 125 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAKDGGYCGGDCYSDGVDYWGQGTLVTVSS

SEQ ID NO: 758 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYVVFGGGTKLTVL

SEQ ID NO: 759 - protein, 122 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAKGYTWDYYYYGMDVWGQGTTVTVSS

SEQ ID NO: 760 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 761 - protein, 129 aa, Homo sapiens
QLQLQESGPGLVKPSETLSLTCSVSGGSISSSSYHWGWIRQPPGKGLEWIGSIYYSGSTYYNPSLKSRVTISVDTSKNQFSLKLRSVTAADTAVYYCAGLRVVITFGGVIPKGGAFDIWGQGTMVTVSS

SEQ ID NO: 762 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVL

SEQ ID NO: 763 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPYSGSYQSYFDYWGQGTLVTVSS

SEQ ID NO: 764 - protein, 108 aa, Homo sapiens
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 765 - protein, 119 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVGSSSWYFDYWGQGTLVTVSS

SEQ ID NO: 766 - protein, 106 aa, Homo sapiens
SYELTQPPSVSVSPGQTASITCSGDKLGDKYACWYQQKPGQSPVLVIYQDNKRPSGIPERFSGSNSGNTATLTISGTQAMDEADYYCQAWDSSTGVFGGGTKLTVL

SEQ ID NO: 767 - protein, 124 aa, Homo sapiens
QVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCAREETLGSSWYESYIDYWGQGTLVTVSS

SEQ ID NO: 768 - protein, 109 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPRVFGGGTKLTVL

SEQ ID NO: 769 - protein, 126 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARMLIAAAGTSRDYYGMDVWGQGTTVTVSS

SEQ ID NO: 770 - protein, 108 aa, Homo sapiens; identical to SEQ ID NO: 758

SEQ ID NO: 771 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLGGSYYSLFDYWGQGTLVTVSS

SEQ ID NO: 772 - protein, 111 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVVFGGGTKLTVL

SEQ ID NO: 773 - protein, 130 aa, Homo sapiens
EVQLVESGGGLVKPGGSLRLSCAASGFTLSSYSMNWVRQAPGKGLEWVSCISSSSSYIYYADSVKGRFTISRDNAKNSLYLQMNSLRAEDTAVYYCASDPLDIVVVPAARDYYYYGMDVWGQGTTVTVSS

SEQ ID NO: 774 - protein, 107 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTFYVFGTGTKVTVL

SEQ ID NO: 775 - protein, 122 aa, Homo sapiens
QVQLVQSGSELKKPGASVKLSCQASGYSFTNHAMNWVRQAPGQGLEWMGWINTNTGNPTYAQGFTGRFVFSLDTSVSTTYLHISSLKAEDTAVYYCARASARPGVATNLDFWGQGTLVVVSS

SEQ ID NO: 776 - protein, 107 aa, Homo sapiens
DIQMTQSPSSLSASVGDRVTITCRASQNIDNYLNWYQQKPGKAPKLLIYAASRLHSGVPSRFSGSGSGTDFTLIISSLQPEDLATYYCQQSYSNPLTFGPGTKVDIR

SEQ ID NO: 777 - protein, 120 aa, Homo sapiens
QVHLVESGGGVVQPGRSLRLSCAASGFTLTAYAMHWVRQAPGKRLEWVALISYDGSVKKYADSVKGRITVSGDTSTNTLHLQMNSLRADDTAVYYCVRGGVSGPNSFDLWGQGTMVTVSS

SEQ ID NO: 778 - protein, 112 aa, Homo sapiens
DVVMTQSPLSLPVTLGQPASMSCRSSQSLEYSDGNTYVNWFHQRPGQSPRRLIYKVSYRDSGVPDRFSGSGSGTDFTLQISRVEAEDVGIYYCMQGTHWPVTFGQGTKVEIK

SEQ ID NO: 779 - protein, 127 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCASSPAAAGTSQYYYYYGMDVWGQGTTVTVSS

SEQ ID NO: 780 - protein, 112 aa, Homo sapiens
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPYTFGQGTKLEIK

SEQ ID NO: 781 - protein, 124 aa, Homo sapiens
QVQLVESGGGVVPPGRSLSLPCAASGFSFSAYAMHWLRQAPGKGLEWVAVISYDGTVKYVADSVRGRFTISRDNSNNTLYLQMTSLRSDDTAVYYCARDLGALAAAPTVYFVHWGQGTLVTVSS

SEQ ID NO: 782 - protein, 108 aa, Homo sapiens
SYVLTQPPSVSVAPGKTATITCAGEDIGRKSVHWYQQKPGQAPVLVIFYYSDRPSGIPDRFSGSVSGNTATLTIGRVEAGDEADYFCQVWDRTTNHVIFGGGTKVTVL

SEQ ID NO: 783 - protein, 120 aa, Homo sapiens
QVQLVESGGGVVQPGRSLRLSCAASGFNLSNYAMHWVRQASGKGLEWVSLISYDGSIKYYTDSVKGRFTVSGDNSKNTLFLQMNSLRPDDSALYYCVRGGVSGPNSFDMWGQGTTVTVSS

SEQ ID NO: 784 - protein, 112 aa, Homo sapiens; identical to SEQ ID NO: 678

SEQ ID NO: 785 - protein, 127 aa, Homo sapiens
QVQLVQSGAEVKKPGASVKVSCKASGYTFTSYGISWVRQAPGQGLEWMGWISAYNGNTNYAQKLQGRVTMTTDTSTRTAYMELRSLRSDDTAVYYCARVGCYYDSSGYSCAENFQHWGQGTLVTVSS

SEQ ID NO: 786 - protein, 110 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSALFGGGTKLTVL

SEQ ID NO: 787 - protein, 124 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATEITPRFLEWKAPFDPWGQGTLVTVSS

SEQ ID NO: 788 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPSTFGQGTKLEIK

SEQ ID NO: 789 - protein, 119 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDEDVAAALDYWGQGTLVTVSS

SEQ ID NO: 790 - protein, 110 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHPERVFGGGTKLTVL

SEQ ID NO: 791 - protein, 121 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATSTIFAPGGWFDPWGQGTLVTVSS

SEQ ID NO: 792 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSTHYVFGTGTKVTVL

SEQ ID NO: 793 - protein, 126 aa, Homo sapiens; identical to SEQ ID NO: 715

SEQ ID NO: 794 - protein, 108 aa, Homo sapiens
EIVLTQSPGTLSLSPGERATLSCRASQSVSGRYLAWYQQKPGQAPRLLIYGASSRATGIPDRFSGSGSGTDFTLTISRLEPEDFAVYYCQHYGSSPGTFGQGTRLEIK

SEQ ID NO: 795 - protein, 121 aa, Homo sapiens
QVQLQESGPGLVKPSQTLSLTCTVSGGSISGGGYYWSWIRQHPGKGLEWIGYIYYSGSTYYNPSLQSRVTISVDTSKNQFSLKLSSVTAADTAVYYCARVGTSSVWYFDYWGQGTLVTVSS

SEQ ID NO: 796 - protein, 108 aa, Homo sapiens
QSALTQPRSVSGSPGQSVTISCTGTSSDVGGYNYVSWYQQHPGKAPKLMIYDVTKRPSGVPDRFSGSKSGNTASLTISGLQAEDEADYYCSSYAGSWVFGGGTKLTVL

SEQ ID NO: 797 - protein, 121 aa, Homo sapiens
QITLKESGPTLVKPTQTLTLTCTFSGFSLNTSGVGVGWIRQPPGKALEWLSLIFWNDDKRYSPSLRSRLTITKDTSKNQVVLTMTNMDPVDTATYFCAHRNSGWSLKFDSWGQGSLVTVSA

SEQ ID NO: 798 - protein, 107 aa, Homo sapiens
DIQMTQSPSSVSASVGDRVTITCRARQGISSWLVWYQQKPGKAPKLLIFGASSLQSGVPSRFNASGTGTEFTLTISSLQPEDFATYYCQQADSFPITFGQGTRLEIK

SEQ ID NO: 799 - protein, 120 aa, Homo sapiens; identical to SEQ ID NO: 783

SEQ ID NO: 800 - protein, 112 aa, Homo sapiens
DVVMTQSPLSLPVTLGQPASISCRSSQSLVYSDGNTYVNWFQQRPGQSPRRLIYQVSIRASGVPDRFSGSGSGTDFALKISRVEAEDVGIYYCMQGTHWPVTFGQGTKVEIK

SEQ ID NO: 801 - protein, 126 aa, Homo sapiens; identical to SEQ ID NO: 715

SEQ ID NO: 802 - protein, 107 aa, Homo sapiens
DIQMTQSPSSLSASVGDRVTITCRASQGIRNDLGWYQQKPGKAPKRLIYAASSLQSGVPSRFSGSGSGTEFTLTVSGLQPEDFATYYCLQYNSSPLTFGGGTKVEIK

SEQ ID NO: 803 - protein, 120 aa, Homo sapiens
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCAREGIVATITLDYWGQGTLVTVSS

SEQ ID NO: 804 - protein, 107 aa, Homo sapiens
SYELTQPPSVSVSPGQTASITCSGDKLGDKYACWYQQKPGQSPVLVIYEDTKRPSGIPERFSGSNSGNTATLTISGTQAMDEADYYCQAWDSSTACVFGTGTKVTVL

SEQ ID NO: 805 - protein, 134 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDFQYYDFWSGYLTVSSPTSYYGMDVWGQGTTVTVSS

SEQ ID NO: 806 - protein, 110 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVVFGGGTKLTVL

SEQ ID NO: 807 - protein, 118 aa, Homo sapiens
QITLKESGPTLVKPTETLTLTCSFSGFSLTKTGEAAGWIRQAPGRALEWVTVIFWDDDKRYSPSLQNRISVTKDTSKNQVVLRMTNVARFDTGTYFCWAMGGPGKEYFGQGTLVAVSS

SEQ ID NO: 808 - protein, 112 aa, Homo sapiens
QSVLTQPPSVSGAPGQRVTISCTGTSSSIGPYSDVHWYQHVSGKAPRLLIFGNSNRPSGVPDRFSGSKSGTSASLVIAGLQAEDEADYYCQSYDSSLGEIYVFGTGTTVTVL

SEQ ID NO: 809 - protein, 124 aa, Homo sapiens
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIHDDILTGYHYVDYWGQGTLVTVSS

SEQ ID NO: 810 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPGTFGQGTKVEIK

SEQ ID NO: 811 - protein, 117 aa, Homo sapiens
QVHLVESGGGVVLPGRSLRLSCSASQFIFSNYDMHWVRQSPGMGLEWVAGISSDGSDKYYIDSVRGRFTISRDNAKNTLFLQMNSLTTEDTAVYSCAKGGGKFGQYWGRGTLVTVSS

SEQ ID NO: 812 - protein, 107 aa, Homo sapiens
AIQMTQSPSSLSASVGDRVTITCRASQVIRNDLAWFQQKPGEAPNLLVYSASNLQSGVPSRFSGSGSGTDFTLTISSLQPEDFATYYCLQDYSYPYTFGQGTKLDMK

SEQ ID NO: 813 - protein, 120 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNRMRAEDTAVFYCARDPVAVAGPFDYWGQGTLVTVSS

SEQ ID NO: 814 - protein, 106 aa, Homo sapiens
SYELTQPPSVSVSPGQTASITCSGDKLGDKYAYWYQQKPGQSPVLVIYQDSKRPSGIPERFSGSNSGNTATLTISGTQAMDEADYYCQAWDSSTVVFGGGTKLTVL

SEQ ID NO: 815 - protein, 126 aa, Homo sapiens
EVQLLESGGGLVQPGGSLRLSCAASGFTFSSYAMSWVRQAPGKGLEWVSVIYSGGSSTYYADSVKGRFTISRDNSKNTLYLQMNSLRAEDTAVYYCATHTYYFDSGSYNYEEVDYWGQGTLVTVSS

SEQ ID NO: 816 - protein, 107 aa, Homo sapiens; identical to SEQ ID NO: 744

SEQ ID NO: 817 - protein, 123 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAQTDYYDSSGWFDYWGQGTLVTVSS

SEQ ID NO: 818 - protein, 109 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTPHWVFGGGTKLTVL

SEQ ID NO: 819 - protein, 128 aa, Homo sapiens
QVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCAKDTGGYCSGGSCYPESYFDYWGQGTLVTVSS

SEQ ID NO: 820 - protein, 109 aa, Homo sapiens
SYVLTQPPSVSVAPGKTARITCGGNNIGSKSVHWYQQKPGQAPVLVIYYDSDRPSGIPERFSGSNSGNTATLTINRVEAGDEADYYCQVWDGSSDHLYVFGTGTKVTVL

SEQ ID NO: 821 - protein, 123 aa, Homo sapiens
QVQLQESGPGLVKPSETLSLTCAVSGYSISSDYYWGWIRQPPGKGLEWIGSIYHSGSTYYNPSLKSRVTISIDTSKNQFSLKLSSVTAADTAVYYCARDPGNYDILTGIFDYWGQGTLVTVSS

SEQ ID NO: 822 - protein, 113 aa, Homo sapiens
QSALTQPASVSGSPGQSITISCTGTSSDVGVYNYVSWYQQHPGKAPKLMIYDVTNRPSGVSNRFSGSKSGNTASLTISGLQAEDEADYYCSSYTSSSTLAVYVFGTGTKVTVL

SEQ ID NO: 823 - protein, 118 aa, Homo sapiens
QITLKESGPTLVKPTETLTLTCSFSGFSLTRTGEAAGWIRQAPGRALEWVTVIFWDDDKRYSPSLQSRLTVTKDTSKNQVVLTMTNVARFDTATYFCWAMGGPGKEYFGQGTQVAVSS

SEQ ID NO: 824 - protein, 112 aa, Homo sapiens; identical to SEQ ID NO: 808

SEQ ID NO: 825 - protein, 126 aa, Homo sapiens
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGRYCTGGVCWGDWYFDLWGRGTLVTVSS

SEQ ID NO: 826 - protein, 111 aa, Homo sapiens
QSVLTQPPSVSGAPGQRVTISCTGSSSNIGAGYDVHWYQQLPGTAPKFLIYGNSNRPSGVPDRFSGSKSGTSASLAITGLQAEDEADYYCQSYDSSLSGPVFGGGTKLTVL

SEQ ID NO: 827 - protein, 124 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRPLRYFDWLTNFDYWGQGTLVTVSS

SEQ ID NO: 828 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 829 - protein, 130 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATGGVSVWFREFPASYSGSYLGYWGQGTLVTVSS

SEQ ID NO: 830 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 831 - protein, 121 aa, Homo sapiens
QVQLVESGGDVVQPGTSLRLSCAASGFTFNNYGFHWVRQAPGKGLEWVALISSDGASTHYADSVKGRFTISRDSSVNTLYLQMNSLSLEDTAVYYCATGHCGTTCYYFDYWGQGTLVSVSS

SEQ ID NO: 832 - protein, 107 aa, Homo sapiens
DIQVTQSPSYLSASVGDRVTITCRASQTISTFLQWYQQKVGKAPKLLIYAASTLQSGVPSRFSGSGSGTDFSLTISSLQPEDFATYYCQQSYSAPLSFGGGTKVEIK

SEQ ID NO: 833 - protein, 121 aa, Homo sapiens
QVQLVESGGGVVQPGRSLRLSCAASGFTFSSYAMHWVRQAPGKGLEWMAVISYDGSNKYYADSVKGRFTISRDNSKNTLYLQMNSLRAEDTAVYFCAKGYSGSYYEPFDYWGQGTLVTVSS

SEQ ID NO: 834 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGGGTKVEIK

SEQ ID NO: 835 - protein, 126 aa, Homo sapiens
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARVGMVDNWNFEGNWFDPWGQGTLVTVSS

SEQ ID NO: 836 - protein, 108 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSVVFGGGTKLTVL

SEQ ID NO: 837 - protein, 124 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARHGPQDGYSSSWYLDYWGQGTLVTVSS

SEQ ID NO: 838 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPDTFGQGTKLEIK

SEQ ID NO: 839 - protein, 125 aa, Homo sapiens
QVQLVQSGAEVKKPGASVKVSCKASGYTFTGYYMHWVRQAPGQGLEWMGWINPNSGVTNYAQKFQGRVTMTRDTSISTAYMELSRLRSDDTAVYYCAREAYYYISGSYGNWFDPWGQGTLVTVSS

SEQ ID NO: 840 - protein, 110 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPLYTFGQGTKLEIK

SEQ ID NO: 841 - protein, 125 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARDHELPNTSSWFGHFEYWGQGTLVTVSS

SEQ ID NO: 842 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTSVVFGGGTKLTVL

SEQ ID NO: 843 - protein, 132 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATENKVPTIIAAAGTRDYYYYGMDVWGQGTTVTVSS

SEQ ID NO: 844 - protein, 114 aa, Homo sapiens
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPAYTFGQGTKLEIK

SEQ ID NO: 845 - protein, 122 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAPPYSPPSSWFDPWGQGTLVTVSS

SEQ ID NO: 846 - protein, 111 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSASYVFGTGTKVTVL

SEQ ID NO: 847 - protein, 126 aa, Homo sapiens
HVQLVESGGGVVQPGRSLRLSCAASGFISRNYGMEWVRQAPGQGLEWVAGIWYDGSKKYYADSVKGRFTISRDTSKNTLFLQMDSLRAEDTAVFYCATATKTFCGGDCPPGGMDVWGQGTTVTVST

SEQ ID NO: 848 - protein, 108 aa, Homo sapiens
SYVLTQPPSVSVAPGKTAWITCVGNNIESESVHWYQQRPGQAPVLVIYYDSDRPSGIPERFFGSNSGNTATLTISRVEAGDEADYYCQVWDSNSDLMVFGGGTKLTVL

SEQ ID NO: 849 - protein, 127 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKVGVEEEVVVVAVPYGMDVWGQGTTVTVSS

SEQ ID NO: 850 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTEVFGGGTKLTVL

SEQ ID NO: 851 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPRSGSYYAYFDYWGQGTLVTVSS

SEQ ID NO: 852 - protein, 107 aa, Homo sapiens
DIQMTQSPSSLSASVGDRVTITCRASQGISNYLAWFQQKPGKAPKSLIYAASSLQSGVPSKFSGSGSGTDFTLTISSLQPEDFATYYCQQYNSYPPTFGGGTKVEIK

SEQ ID NO: 853 - protein, 127 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRPYYYGSGIPGYYGMDVWGQGTTVTVSS

SEQ ID NO: 854 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTSYTFGQGTKLEIK

SEQ ID NO: 855 - protein, 123 aa, Homo sapiens
QVHLVESGGGVVQPGRSLRLSCAASGFTFSSFPMHWVRQAPGKGLEWVAVISYDGGDEHYTDSVEGRFTISRDNSLNTLYLQMSSLRLEDTAVYYCARDRYDSSGYYYVSDYWGQGTLITVSS

SEQ ID NO: 856 - protein, 109 aa, Homo sapiens
SYELTQPPSVSVSPGQTARISCSGDALPKQYAYWYQQKPGQAPVLVIYKDSERPSGIPERFSGSSSGTTVTLTISGVQAEDEADYYCQSADSRGTDPWVFGGGTKLTVL

SEQ ID NO: 857 - protein, 123 aa, Homo sapiens
QVQLVQSGAEVKKPGASVKVSCKASGYTFTSYGISWVRQAPGQGLEWMGWISAYHGNTNYAQKLQGRVTMTTDTSTSTAYMELRSLRSDDTAVYYCARVGLWWLGHADAFDIWGQGTMVTVSS

SEQ ID NO: 858 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPLTFGGGTKVEIK

SEQ ID NO: 859 - protein, 123 aa, Homo sapiens
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGPIAVAGIGPWFDPWGQGTLVTVSS

SEQ ID NO: 860 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 861 - protein, 120 aa, Homo sapiens
QVQLVESGGGVVQPGRSLRLSCAASGFNLNSYAMHWVRQASGKGLEWVSLMSYDGSIKYYADSVKGRFTVSGDNSRNTLFLQMNSLRPDDSALYYCVRGGVSGPNSFDLWGQGTTVTVSS

SEQ ID NO: 862 - protein, 112 aa, Homo sapiens
DVVMTQSPLSLPVTLGQPASISCRSSQSLVYSDGSTYVNWFQQRPGQSPRRLIYKVSNRDSGVPDRFSGSGSGTDFALKISRVEAEDVGVYYCMQGTHWPVTFGQGTKVEIK

SEQ ID NO: 863 - protein, 118 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAYSGNYWYFDLWGRGTLVTVSS

SEQ ID NO: 864 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPLFTFGPGTKVDIK

SEQ ID NO: 865 - protein, 122 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGKNSGSYFFAFDIWGQGTMVTVSS

SEQ ID NO: 866 - protein, 112 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTYTFGQGTKLEIK

SEQ ID NO: 867 - protein, 126 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCATTMVRGVIRLDHYGMDVWGQGTTVTVSS

SEQ ID NO: 868 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLLFGTGTKVTVL

SEQ ID NO: 869 - protein, 120 aa, Homo sapiens
QVQLVESGGGVVQPGRSLRLSCAASGFNLSNYAMHWVRQASGKGLEWVSLISYDGSVKYYTDSVKGRFTVSGDNSKNTLFLQMNSLRPDDSALYYCVRGGVSGPNSFDMWGQGTTVTVSS

SEQ ID NO: 870 - protein, 112 aa, Homo sapiens
DVVMTQSPLSLPVTLGQPATISCRSSQSLVYSDGNTYVNWFQQRPGQSPRRLIYQVSIRASGVPDRFSGSGSGTDFALKISRVEAEDVGVYYCMQGTHWPVTFGQGTKVEIK

SEQ ID NO: 871 - protein, 115 aa, Homo sapiens; identical to SEQ ID NO: 753

SEQ ID NO: 872 - protein, 108 aa, Homo sapiens
EIEMTQSPATLSVSPGERATLSCRASQSVSSNLAWYQQKPGQAPRLLIYGASTRATGIPARFSGSGSGTEFTLTISSLQSEDFAVYYCQQYNNWPPYTFGQGTKLEIK

SEQ ID NO: 873 - protein, 131 aa, Homo sapiens
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRFGIDYDYIWGSYRYTTLFDYWGQGTLVTVSS

SEQ ID NO: 874 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSYTFGQGTKLEIK

SEQ ID NO: 875 - protein, 120 aa, Homo sapiens
QVQLVESGGGVVQPGRSLRLSCAASGFNLSSYAMHWVRQASGKGLEWVSLISYDGSIKYYTDSVKGRFTVSGDNSKNTLFLQMNSLRPDDSALYYCVRGGVSGPNSFDMWGQGTTVTVSS

SEQ ID NO: 876 - protein, 112 aa, Homo sapiens
DVVMTQSPLSLPVTLGQPASISCRSSQSLVYSDGNTYVNWFQQRPGQSPRRLIYKVSIRASGVPDRFSGSGSGTDFALKISRVEAEDVGVYYCMQGTHWPVTFGQGTKVEIK

SEQ ID NO: 877 - protein, 119 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGLVGYNWFDPWGQGTLVTVSS

SEQ ID NO: 878 - protein, 105 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFTFGPGTKVDIK

SEQ ID NO: 879 - protein, 128 aa, Homo sapiens
QVQLVQSGAEVKKPGASVKVSCKASGYTFTGYYIHWVRQAPGQGLEWMGWINPNSGGTIYAQKFQGRVTMTRDTSISTAYMELSRLTSDDTAVYSCAREPYYDILTGYYAPRRYFDYWGQGTLVTVSS

SEQ ID NO: 880 - protein, 110 aa, Homo sapiens
QSALTQPASVSGSPGQSITISCTGTSSDVGSYNYVSWYLQHPGKAPKLMIYDVSNRPSGVSNRFSGSKSGNTASLTISGLQAEDEADFYCSSYTSRSTYVFGTGTKVTVL

SEQ ID NO: 881 - protein, 118 aa, Homo sapiens
QITLKESGPTLVKPTETLTLTCAFSGFSLTKTGEAAGWIRQAPGRALEWVTVIFWDDDKRYSPSLQNRLTVTKDTSKNVVVLTMTNVDPVDTATYFCWAMGGPGKEFFGQGTRVAVSS

SEQ ID NO: 882 - protein, 112 aa, Homo sapiens
QSVLTQPPSVSGAPGQRVTVSCTGTSSSIGPYSDVHWYQHIPGKAPRLLIFGTSNRPSGVPARFSGSKSGSSASLVIAGLQAEDEADYYCQSYDSSLGEIYVFGTGTTVTVL

SEQ ID NO: 883 - protein, 119 aa, Homo sapiens
QVQLVESGGGVVQPGRSLRLSCAASGFTFSNYAMHWVRQAPGKGLEWVAVISYDGSNKYYADSVKGRFTISRDNSKNTLYLQMNSLRAEDTAVYYCGRGGGGYVYFDYWGQGTLVTVSS

SEQ ID NO: 884 - protein, 109 aa, Homo sapiens
EIVLTQSPGTLSLSPGERATLSCRASQSVSSSYLAWYQQKPGQAPRLLIYGAYNRATGIPDRFSGSGSGTDFTLTISRLEPEDFAVYYCQQYGSSPGYTFGQGTKLEIK

SEQ ID NO: 885 - protein, 124 aa, Homo sapiens
QVQLVESGGGVVPPGRSLSLPCAASGFTFSAYAMHWLRQAPGKGLEWVAVISYDGTVKYVADSVRGRFTISRDNSNNTLYLQMTSLRSDDTAVYYCARDLGALAAAPTVYFVHWGQGTLVTVSS

SEQ ID NO: 886 - protein, 108 aa, Homo sapiens; identical to SEQ ID NO: 782

SEQ ID NO: 887 - protein, 133 aa, Homo sapiens
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCARGVLVSGSNNDLGDDYYYYYGMDVWGQGTTVTVSS

SEQ ID NO: 888 - protein, 108 aa, Homo sapiens; identical to SEQ ID NO: 758

SEQ ID NO: 889 - protein, 130 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLGTSALLWFGELFLNYGMDVWGQGTTVTVSS

SEQ ID NO: 890 - protein, 110 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSPILVFGGGTKLTVL

SEQ ID NO: 891 - protein, 125 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGPDYYDFWSGYFYGMDVWGQGTTVTVSS

SEQ ID NO: 892 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 893 - protein, 119 aa, Homo sapiens
QVQLQESGPGLVKPSGTLSLTCAVSGGSISSSKWWSWVRQPPGKGLEWIGEIYHSGSTNYNPSLKSRVTISVDKSKNQFSLKLSSVTAADTAVYYCARRELGEGTFTYWGQGTLVTVSS

SEQ ID NO: 894 - protein, 109 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPSLTFGGGTKVEIK

SEQ ID NO: 895 - protein, 130 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDSLLRFLEWPQGVNYYYYGMDVWGQGTTVTVSS

SEQ ID NO: 896 - protein, 108 aa, Homo sapiens
SSELTQDPAVSVALGQTVRITCQGDSLRSYYASWYQQKPGQAPVRVIYGKNNRPSGIPDRFSGSSSGNTASLTITGAQAEDEADYYCNSWDSSGNHPCMGGGTKLTVL

SEQ ID NO: 897 - protein, 126 aa, Homo sapiens
QVQLQESGPGLVKPSETLSLTCTVSGGSINSYFWSWIRQPAGKGLEWIGRILPSGSTNYNPSLKSRVTMSVDTSKNQFSLKVSSVTAADTAVYYCARDQPTTVTRGYYYYNGMDVWGQGTTVTVSS

SEQ ID NO: 898 - protein, 107 aa, Homo sapiens
EIVLTQSPATLSLSPGERATLSCRASQSVSSYLAWYQQKPGQAPRLLISDASNRATGIPARFSGSGSGTDFTLTISSLEPEDFAVYYCQQRSNWPITFGQGTRLEIK

SEQ ID NO: 899 - protein, 124 aa, Homo sapiens
EVQLVESGGGLVKPGGSLRLSCATSGFTFRTYSMNWVRQAPGKGLEWVSSITTSRNYIYYADSVRGRFTISGDNANNSLYLQMNSLRAEDTAVYYCARVRFVRDTRKPYYFDFWGQGTLVTVSS

SEQ ID NO: 900 - protein, 110 aa, Homo sapiens
QSVLTQPPSASGTPGQRVTISCSGSTSNIGSLAVNWYQQLPGTAPKLLIYNNNQRPSGVPDRFSGSKSGTSASLAISGPQSEDEADYYCAAWDDSLNGWVFGGGTKLTVL

SEQ ID NO: 901 - protein, 128 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDSGGMDDFWSGYYSPGGDYWGQGTLVTVSS

SEQ ID NO: 902 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTWVFGGGTKLTVL

SEQ ID NO: 903 - protein, 127 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGPLDFWSGYFRLRYFDSWGQGTLVTVSS

SEQ ID NO: 904 - protein, 110 aa, Homo sapiens
QSALTQPASVSGSPGQSITISCTGTSSDVGGYNYVSWYQQHPGKAPKLMIYDVTNRPSGVSNRFSGSKSGNTASLTISGLQAEDEADYYCSSYTSSSTCVFGTGTKVTVL

SEQ ID NO: 905 - protein, 124 aa, Homo sapiens
QVQLVESGGGVVQPGRSLRLSCAASGFTLKNYGMHWVRQAPGKGLEWVIVLSFDGSDEYKADSVRGRFTVSRDNSKNTLFLQMNSLRPDDTAVYYCAREQPTMIEGGRGPFDIWGQGTMVTVSS

SEQ ID NO: 906 - protein, 108 aa, Homo sapiens
EVVMTQSPATLSVSPGDRATLSCRASQGVNSNLAWYQQKPGQAPRLLIYAASTRATGIPARFSASGSGTHFTLTISSLQSEDFAVYYCLQYNNWPPWTFGQGTKLEIK

SEQ ID NO: 907 - protein, 131 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDRQYYDILTGYYLPTSEYYFDYWGQGTLVTVSS

SEQ ID NO: 908 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPPTFGGGTKVEIK

SEQ ID NO: 909 - protein, 123 aa, Homo sapiens
QVQLVESGGGVVQPGRSLRLSCAASGFTFSNYGMHWVRQAPGKGLEWMTVISFDGRNKYYADSVKGRFTISRDNSKNTLFLQMNSLTTEDTALYFCASGRRPRYSSGWSFDYWGQGTLVTVSS

SEQ ID NO: 910 - protein, 107 aa, Homo sapiens
DIQMTQSPSSLSASVGDRVTITCQASQDIGNYLNWYQQKLGKAPNLLIYDASNLETGVPSRFSGSGSGTDFTFTINSLQPEDTATYYCQQYDDPSITFGQGTRLEIK

SEQ ID NO: 911 - protein, 122 aa, Homo sapiens
EVQLVESGGGLVQPGGSLRLSCAASGFTFSSYDMHWVRQATGKGLEWVSTIGTAGDTYYPGSVKGRFTISRENAKNSLYLQMNSLRAGDTAVYYCARVAYSSSFVYWYFDLWGRGTLVTVSS

SEQ ID NO: 912 - protein, 108 aa, Homo sapiens
DIQMTQSPSSLSASIGDRVTITCRASQSISSYLNWYQQKPGKAPNLLIYAASSLQSGVPSRFSGSGSGTDFTLTISSLQPEDFATYYCQQSYTTPLYTFGQGTKLEIK

SEQ ID NO: 913 - protein, 119 aa, Homo sapiens
QVQLVESGGGVVQPGRSLRLSCAASGFTFSSYAMHWVRQAPGKGLEWVAVISYDGSNKYYADSVKGRFSISRDNSKNTLYLQMNSLRAEDTAVYYCARSSGGYYYFDYWGQGTLVTVSS

SEQ ID NO: 914 - protein, 104 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQNSALTFGGGTKVEIK

SEQ ID NO: 915 - protein, 121 aa, Homo sapiens
QVQLVESGGGVVQPGRSLRLSCAASGFTFSSYAIHWVRQAPGKGLEWVAVISYDGSNKYYADSVKGRFTISRDNSKNTLYLQMNSLRAEDTAVYYCARPRSGSYWGAFDIWGQGTMVTVSS

SEQ ID NO: 916 - protein, 110 aa, Homo sapiens
QSVLTQPPSVSGAPGQRVTISCTGSSSNIGARYDVHWYQQLPGTAPKLLIYGNSNRPSGVPDRFSGSKSGTSASLAITGLQAEDEADYYCQSYDSSLRGVFGGGTKLTVL

SEQ ID NO: 917 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAYGGSYGGWFDPWGQGTLVTVSS

SEQ ID NO: 918 - protein, 106 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGQGTKVEIK

SEQ ID NO: 919 - protein, 122 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDDTKNYGDLDIDYWGQGTLVTVSS

SEQ ID NO: 920 - protein, 107 aa, Homo sapiens
SYELTQPSSVSVSPGQTARITCSGDVLAKKYARWFQQKPGQAPVLVIYKDSERPSGIPERFSGSSSGTTVTLTISGAQVEDEADYYCYSAADNNLGVFGGGTKLTVL

SEQ ID NO: 921 - protein, 120 aa, Homo sapiens
QVQLVESGGGVVQPGRSLRLSCAASGFTFNSYAIHWVRQAPGKGLEWVAVISYDGSNKYYADSVKGRFTISRDNSKNTLYLQMNSLRAEDTAVYYCARGRGGYRSYFDYWGQGTLVTVSS

SEQ ID NO: 922 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPNTFGQGTKLEIK

SEQ ID NO: 923 - protein, 123 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASQGRMYVRGVDYGVYWGQGTLVTVSS

SEQ ID NO: 924 - protein, 113 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSKISHAVFGGGTQLTVL

SEQ ID NO: 925 - protein, 124 aa, Homo sapiens
EVQLVESGGGLIQPGGSLRLSCAASGFTVSSNYMSWVRQAPGKGLEWVSIIYSGGSTYYADSVKGRFTISRDNSKNTLYLQMNSLRAEDSAVYSCATTMVRGLIISYYYGMDVWGQGTTVTVSS

SEQ ID NO: 926 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGGGTKLTVL

SEQ ID NO: 927 - protein, 125 aa, Homo sapiens
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCALGPLDIVGSYYYYGMDVWGQGTTVTVSS

SEQ ID NO: 928 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQDVVFGGGTKLTVL

SEQ ID NO: 929 - protein, 120 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARGWRATLYGMDVWGQGTTVTVSS

SEQ ID NO: 930 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTWVFGGGTKLTVL

SEQ ID NO: 931 - protein, 122 aa, Homo sapiens
QVQLVESGGGVVQPGRSLRLSCAASGFTFSSYAMHWVRQAPGQGLEWVAVISYDGSNKYYADSVKGRFTISRDNSKNTLYLQMNSLRAEDTAVYYCARAGSGSRHYYGMDVWGQGTTVTVSS

SEQ ID NO: 932 - protein, 112 aa, Homo sapiens
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGTHWPPTFGQGTKVEIK

SEQ ID NO: 933 - protein, 125 aa, Homo sapiens
QVQLVQSGAEVKKPGASVKVSCKASGYTFTGYYMHWVRQAPGQGLEWMGWINPNNGGTNSAQKFQGRVTMTRDTSISTAYMELNRLRSDDTAVYYCARDITTTAGTDYYYGMDVWGQGTTVTVSS

SEQ ID NO: 934 - protein, 108 aa, Homo sapiens
SYELTQPPSVSVSPGQTARITCSGDALPKQYAYWYQQKPGQAPVLVICKDSERPSGIPERFSGSSSGTTVTLTISGVQAEDEADYYCQSADSSGTYIVFGTGTKVTVL

SEQ ID NO: 935 - protein, 122 aa, Homo sapiens
QVQLVQSGSELKKPGASVKLSCQASGYTFSNHAMNWVRQAPGQGLEWMGWINTNTGNPTYAQGFTGRFVFSLDTSVGTAYLHISSLKAEDTAFYYCARASARPGVATNLDFWGQGTLVVVSS

SEQ ID NO: 936 - protein, 107 aa, Homo sapiens
DIQMTQSPSSLSASVGDRVTITCRTSQNIDNYLNWYQQKPGKAPNLLIYAASRLHSGVPSRFSGSGSGTDFTLIISSLQPEDLATYYCQQSYSNPLTFGPGTKVDIR

SEQ ID NO: 937 - protein, 124 aa, Homo sapiens
QVQLQQWGAGLLKPSETLSLTCAVYGGSFSGYYWSWIRQPPGKGLEWIGEIIHSGSTNYNPSLKSRVTISVDTSKNQFSLKLSSVTAADTAVYYSARRTGLLWFREGSYYFDYWGQGTLVTVSS

SEQ ID NO: 938 - protein, 107 aa, Homo sapiens; identical to SEQ ID NO: 858

SEQ ID NO: 939 - protein, 122 aa, Homo sapiens
QVQLVESGGGVVQPGRSLRLSCAASGFTFSSYGMHWVRQAPGKGLESVAVISYDGSNKYYADSVKGRFTISRDNSKNTLYLQMNSLRAEDTAVYYCAKEGQWELQGNAFDIWGQGTMVTVSS

SEQ ID NO: 940 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSGDSSGTYRVFGGGTKLTVL

SEQ ID NO: 941 - protein, 112 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLNSVTAADTAVYYCARGFDYWGQGTLVTVSS

SEQ ID NO: 942 - protein, 108 aa, Homo sapiens
EIVLTQSPGTLSLSPGERATLSCRASQSVSSIYLAWYQQKPGQAPRLLIYGASSRATAIPDRFSGSGSGTDFTLTISRLEPEDFAVYYCQQYGSSPWTFGQGTKVEIK

SEQ ID NO: 943 - protein, 127 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDSGYDWAGGHYYYYGMDVWGQGTTVTVSS

SEQ ID NO: 944 - protein, 111 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVVFGGGTKLTVL

SEQ ID NO: 945 - protein, 124 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKAIDILTGYGPGGMDVWGQGTTVTVSS

SEQ ID NO: 946 - protein, 110 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGVVFGGGTKLTVL

SEQ ID NO: 947 - protein, 124 aa, Homo sapiens
QVQLVQSGAEVKKPGSSVKVSCKASGGTFSSYAISWVRQAPGQGLEWMGRIIPILGIANYAQKFQGRVTIIADKSTSTAYMELSSLRSEDKAVYYCAREGKSDSSSALWYFDLWGRGTLVTVSP

SEQ ID NO: 948 - protein, 106 aa, Homo sapiens
SYEVTQPPSVSVSPGQTASITCSGDKLGDKYACWYQQKPGQSPVVVIYKDSKRPSGIPERFSGSNSGNTATLTISGTQAMDEADYYCQAWDSSTVVFGGGTKLTVL

SEQ ID NO: 949 - protein, 128 aa, Homo sapiens
QVQLVQSGAEVKKPGASVKVSCKVSGYTLTELSMHWVRQAPGKGLEWMGGFDPEDVETIYAQKFQGRVTMTEDTSTDTAYMELSSLRSEDTAVYYCATGVAVVGTSHSYYYYYGMDVWGQGTTVTVSS

SEQ ID NO: 950 - protein, 107 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGPGTKVDIK

SEQ ID NO: 951 - protein, 116 aa, Homo sapiens
QVQLVQSGAEVKKPGASVKVSCKASGYTFTSYYMHWVRQAPGQGLEWMGIINPSGSITSYAQKFQGRVTMTRDTSTSTVYMELSSLRSEDTAVYYCARVGGSMDVWGQGTTVTVSS

SEQ ID NO: 952 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPITFGQGTRLEIK

SEQ ID NO: 953 - protein, 124 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARLAVDISFDGSDGMDVWGQGTTVTVSS

SEQ ID NO: 954 - protein, 107 aa, Homo sapiens
SYELTQPPSVSVSPGQTARITCSGDALPKKYAYWYQQKSGQAPVLVIYEDSKRPSGIPERFSGSSSGTMATLTISGAQVEDEADYYCYSTDSSGKGVFGTGTKVTVL

SEQ ID NO: 955 - protein, 124 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREGLAAAGAYNYGMDVWGQGTTVTVSS

SEQ ID NO: 956 - protein, 110 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYNVVFGGGTKLTVL

SEQ ID NO: 957 - protein, 118 aa, Homo sapiens
EVQVLESGGGLVQPGGSLRLSCAASGFTLSNYAMSWVRQAPGKGLEWVSAISGSGYSTYYADSVKGRFTISRDTSKNTLSLQMNSLRAEDTAVYYCAKVGRWYVFDYWGQGTLVTVSS

SEQ ID NO: 958 - protein, 107 aa, Homo sapiens
DIQMTQSPSSLSTSVGDRVTITCRASQGISNFLAWYQQKPGKVPNLLIFDASTLQSGVPSRFSGSGSGTDFTLTISSLQPEDVATYYCQKYNNAPFTFGPGTKVDIK

SEQ ID NO: 959 - protein, 126 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKCGWDYDFWVGQGYGMDVWGQGTTVTVSS

SEQ ID NO: 960 - protein, 107 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTDVVFGGGTKLTVL

SEQ ID NO: 961 - protein, 133 aa, Homo sapiens
QVQLVESGGGVVQPGRSLRLSCAASGFTFSSYAMHWVRQAPGKGLEWVAVISYDGSNKYYADSVKGRFTISRDNSRNTLYLQMNSLRAEDTAVYYCAKGADTPHYSGYDFLSVGYYYYGMDVWGQGTTVTVSS

SEQ ID NO: 962 - protein, 107 aa, Homo sapiens
DIQMTQSPSSLSASVGDRVTITCRASQSISSYLNWYQQKPGKAPKLLIYAASSFQSGVPSRFSGSRSGTDFTLTISSLQPEDFATYYCQQSYSAPFTFGPGTKVDIK

SEQ ID NO: 963 - protein, 125 aa, Homo sapiens
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARTTYYYVSGRRAEFDPWGQGTLVTVSS

SEQ ID NO: 964 - protein, 111 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQGVFGGGTKLTVL

SEQ ID NO: 965 - protein, 125 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGRITIFGVEYYYGMDVWGQGTTVTVSS

SEQ ID NO: 966 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPYTFGQGTKLEIK

SEQ ID NO: 967 - protein, 128 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATSQSVQGVIGHYYYYYGMDVWGQGTTVTVSS

SEQ ID NO: 968 - protein, 111 aa, Homo sapiens
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPSFGQGTKLEIK

SEQ ID NO: 969 - protein, 129 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVTVEAIFGVVILPLKNWFDPWGQGTLVTVSS

SEQ ID NO: 970 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLTLYVFGTGTKVTVL

SEQ ID NO: 971 - protein, 125 aa, Homo sapiens
EVQLVESGGGLIQPGGSLRLSCAASGFTVSGNYMNWVRQAPGKGLEWVSVIYSGGSTYYADSVKGRFTISRANSKNTLYLQMNSLRAEDTAVYYCASTSLVRGLIILYYYGMDVWGQGTTVTVSS

SEQ ID NO: 972 - protein, 110 aa, Homo sapiens; identical to SEQ ID NO: 926

SEQ ID NO: 973 - protein, 135 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDPPGRDFWSGYYFGAPDYYYYYGMDVWGQGTTVTVSS

SEQ ID NO: 974 - protein, 107 aa, Homo sapiens
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIK

SEQ ID NO: 975 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKTRGGSYFDAFDIWGQGTMVTVSS

SEQ ID NO: 976 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPWTFGQGTKVEIK

SEQ ID NO: 977 - protein, 120 aa, Homo sapiens
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDLAWLSGGMDVWGQGTTVTVSS

SEQ ID NO: 978 - protein, 110 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGPVFGTGTKVTVL

SEQ ID NO: 979 - protein, 126 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARAPIMITFGGVTGHFDYWGQGTLVTVSS

SEQ ID NO: 980 - protein, 108 aa, Homo sapiens; identical to SEQ ID NO: 830

SEQ ID NO: 981 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSISGSYLGAFDYWGQGTLVTVSS

SEQ ID NO: 982 - protein, 105 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYTFGQGTKLEIK

SEQ ID NO: 983 - protein, 125 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDWTQSSGYDYYYGLDVWGQGTTVTVSS

SEQ ID NO: 984 - protein, 108 aa, Homo sapiens
SYELTQPPSVSVSPGQTARITCSGDALPKQYAYWYQQKPGQAPVVVIYKDSERPSGIPERFSGSSSGTTVTLTISGVQAEDEADYYCQSADSSGTYVVFGGGTKLTVL

SEQ ID NO: 985 - protein, 121 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAKDGGDYGDVNFDYWGQGTLVTVSS

SEQ ID NO: 986 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSAGSSGNYKVFGGGTKLTVL

SEQ ID NO: 987 - protein, 122 aa, Homo sapiens
QVQLVESGGGVVQPGRSLRLSCAASGFTFSTYAMHWVRQAPGKGLEWVAVISYDGSNKYYADSVKGRFTISRDNSKNTLYLQMNSLRAEDTAVYYCARGYGSGSYYPLYLYWGQGTLVTVSS

SEQ ID NO: 988 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSTFGQGTKLEIK

SEQ ID NO: 989 - protein, 123 aa, Homo sapiens
QVQLVQSGSELKKPGASVKVSCKASGYTFTSYAMNWVRQAPGQGLEWMGWINTNTGNPTYAQGFTGRFVFSLDTSVSTTYLQISSLKAEDTAVYYCARVIGVVTYYYYGMDVWGQGTTVTVSS

SEQ ID NO: 990 - protein, 107 aa, Homo sapiens
DIQMTQSPSSLSASVGDRVTITCRASQSISSYLNWYQQKPGKAPKLLIYTASSLQSGVPSRFSGSGSGTDFTLTISSLQPEDFATYYCQQSYSTPPTFGQGTKLEIK

SEQ ID NO: 991 - protein, 120 aa, Homo sapiens
EVQLVESGGGLIQPGGSLRISCAASGFTVRNNHMSWVRQAPGKGLEWVSVFYRGGTTYYADSVKGRFTISRDDSKNTVDLQMNSLRGEDTAVYYCARGLSVAASGYFDCWGQGTLVTVSS

SEQ ID NO: 992 - protein, 107 aa, Homo sapiens
DIQMTQSPSSVSASVGDTVTITCRANQGISSWLAWYQQVPGKAPELLIYATSTLQSGVPSRFSGSGSGTDFTLTISSLQPEDFATYYCQQANSFPFTFGPGTKVDIK

SEQ ID NO: 993 - protein, 122 aa, Homo sapiens
EVQLVESGGGLVQAGGSLRLSCAASGFTFSTHWMSWVRQVPGKGLEWVANIKKDGGEKYYVDSVKGRFTISRDNAKSSLFLQMNSLRAEDTAVYHCTRDEGTSGWNWYFDLWGRGTLVTVSS

SEQ ID NO: 994 - protein, 107 aa, Homo sapiens
EIVMTQSPATLSVPPGERTTLSCRASQSIDINLAWYQQKPGQAPRPLIYGASTRATGIPARFTGSGSRTEFTLTISSLQSEDFAVYYCQQYDNWPRTFGQGTKVEIK

SEQ ID NO: 995 - protein, 120 aa, Homo sapiens
QVQLQESGPGLVKPSQTLSLTCTVSGGSINSGDYYWSWIRQHPGKGLEWIGYIYYSGSTYYNPSLKSRVTISVDTSKNQFSLKLSSVTAADTAVYYCARGTVTTFYFDYWGQGTLVTVSS

SEQ ID NO: 996 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQHYDNLPLTFGGGTKVEIK

SEQ ID NO: 997 - protein, 129 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREREVDTVVTIFYYYYYGMDVWGQGTTVTVSS

SEQ ID NO: 998 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 999 - protein, 126 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPTLGYCTGGVCYLFDYWGQGTLVTVSS

SEQ ID NO: 1000 - protein, 111 aa, Homo sapiens
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGARLYVFGTGTKVTVL

SEQ ID NO: 1001 - protein, 112 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGFDYWGQGTLVTVSS

SEQ ID NO: 1002 - protein, 108 aa, Homo sapiens
EIVLTQSPGTLSLSPGERATLSCRASQSVSSSYLAWYQQKPGQAPRLLIYGTSTRATGIPDRFSGSGSGTDFTLTISRLEPEDFAVYYCQHYGSSPWTFGQGTKVEIK

SEQ ID NO: 1003 - protein, 125 aa, Homo sapiens; identical to SEQ ID NO: 743

SEQ ID NO: 1004 - protein, 110 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPRYTFGQGTKLEIK

SEQ ID NO: 1005 - protein, 118 aa, Homo sapiens
QVHLVEAGGGVVQPGKSLRLSCAASGFIFSNFGMHWVRQSPGKGLEWVAVVSYDASVTKYSDSFEGRFTISRDNSKNTLYLQMDSLRPEDSAVYYCAKGQGANLLHDWGQGILVTVSS

SEQ ID NO: 1006 - protein, 112 aa, Homo sapiens
DVVLTQSPLSLPVTLGQPASISCRSSESLVYTDGDTYLHWFHQRPGQSPRRLIYKVSNRDSGVPDRFSGSGSGTDFTLRISRVEAEDVGVYYCMQGTHWPFTFGPGTKVDIK

SEQ ID NO: 1007 - protein, 121 aa, Homo sapiens
QVQLVESGGGVVQPGRSLRLSCAASGFTFSSYAMHWVRQAPGKGLEWLAVISYDGSNKYYADSVKGRFTISRDNSKNTLYLQMNSLRAEDTAVYYCARSFRGGYYYGMDVWGQGTTVTVSS

SEQ ID NO: 1008 - protein, 108 aa, Homo sapiens; identical to SEQ ID NO: 740

SEQ ID NO: 1009 - protein, 127 aa, Homo sapiens
QVQLQESGPGLVKPSQTLSLTCTVSGGSISSGGYYWNWIRQHPGKGLEWIGYIYDSGSTYYNPSLKSRLTLSIDTSQNQFSLRRTSVTAADTAVYYCARGRQYDYDRTGLQYYFDYWGQGTLVTVSS

SEQ ID NO: 1010 - protein, 108 aa, Homo sapiens
EIVLTQSPGTLSLSPGERATLSCRASQSFSSSYLAWYQQKPGQAPRLLIYGASSRATGIPDRFSGSGSGTDFTLTISRLEPEDFAVYYCQQYGTSSLTFGGGTKVEIK

SEQ ID NO: 1011 - protein, 125 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDYEVVIAIGGPGAFDYWGQGTLVTVSS

SEQ ID NO: 1012 - protein, 108 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHVVFGGGTKLTVL

SEQ ID NO: 1013 - protein, 126 aa, Homo sapiens
QVQLVQSGAEVKKPGASVQVSCKASGYTFSDYYIFWVRQAPGQGLEWMGCINPKSGGAIYAQRFQGRVTMTRDTSFNTAYMEMNRLGSDDTAVYYCVTRGPPDIAASGFAWHLDVWGQGTTVTVSS

SEQ ID NO: 1014 - protein, 112 aa, Homo sapiens
DIVMTQSPLSLPVTPGEPASISCRSSQSLLSSNGYNYLEWYLQKPGQSPQLLMYLGSNRASGVPDRFSGSGSGTDFTLKINRVEAEDVGVYYCMQALQTPLTFGGGTKVEIK

SEQ ID NO: 1015 - protein, 124 aa, Homo sapiens
QVQLVQSGAEVKKPGASVKVSCKASGYTFTGFYMHWVRQAPGQGLEWMGWINPNSGGTNYAQKFQGRVTMTRDTSISTAYMELSRLRSDDTAVYYCARVAYQLRYYYYYGMDVWGQGTTVTVSS

SEQ ID NO: 1016 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGPGTKVDIK

SEQ ID NO: 1017 - protein, 122 aa, Homo sapiens
QVQVVESGGGVVQPGRSLRLSCAASGFTFSSYAMHWVRQAPGKGLEWVAVISYDGNNEYYVDPVKGRFTISRDNSKNTLYLQMNSLRAEDTALYYCATSREAIVVGGILDYWGQGTLVTVSS

SEQ ID NO: 1018 - protein, 109 aa, Homo sapiens
DIQMTQSPSSLSASVGDRVTITCQASHDINNFLNWYQQKPGQAPKLLIYDASNLETGVPSRFSGSGSGTDFTFTISSLHPEDVATYYCQQYDGLPRYVTFGQGTKLEIR

SEQ ID NO: 1019 - protein, 126 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDEREYCSGGSCNNWFDPWGQGTLVTVSS

SEQ ID NO: 1020 - protein, 106 aa, Homo sapiens; identical to SEQ ID NO: 712

SEQ ID NO: 1021 - protein, 125 aa, Homo sapiens
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDRGYSDYGPYYYGMDVWGQGTTVTVSS

SEQ ID NO: 1022 - protein, 107 aa, Homo sapiens
DIQMTQSPSSLSASVGDRVTITCRASQSISSYLNWYQQKPGKAPKLLIYAASSLQSGVPSRFSGSGSGTHFTLTISSLQPEDFATYYCQQSYSTPYTFGQGTKLEIK

SEQ ID NO: 1023 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPPRGGSYYPFDPWGQGTLVTVSS

SEQ ID NO: 1024 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPRTFGQGTKVEIK

SEQ ID NO: 1025 - protein, 125 aa, Homo sapiens
EVQLLESGGGLVQPGGSLRLSCAASGFTFSSYAMSWVRQAPGKGLEWVSAISGSGVNTYHADSVKGRFTISRDNSRNTLYLQMSSLTAEDTAAYYCAKDFEAASGAYYYYGMDVWGQGTTVTVSS

SEQ ID NO: 1026 - protein, 108 aa, Homo sapiens
SYELTQPPSVSVSPGQTARITCSGDALPDQYAYWYQQKPGQAPVVVIYKDRERPSGIPERFSGSNSGTTVTLTISGVQAEDEADYYCQSADSSATYVVFGGGTKLTVL

SEQ ID NO: 1027 - protein, 120 aa, Homo sapiens
EVQLVESGGGVVRPGGSLRLSCAASGFTFGDYGMSWVRQAPGKGLEWVSGINWNGGSTGYADSVKGRFTISRDNAKNSLYLQMNSLRAEDTALYYCASDLVRGVIGFDYWGQGTLVTVSS

SEQ ID NO: 1028 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGITGVFGGGTKLTVL

SEQ ID NO: 1029 - protein, 121 aa, Homo sapiens
QVQLVESGGGVVQPGRSLRLSSAASGFTFSSYAMHWVRQAPGKGLEWVAVISYDGSNKYYADSVRGRFTISRDNSKNTLYLQMNSLRAEDTAVYYCARPKGGSYSDAFDIWGQGTMVTVSS

SEQ ID NO: 1030 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPQSFGPGTKVDIK

SEQ ID NO: 1031 - protein, 125 aa, Homo sapiens
QMRLEESGPGLVKPSETLSLTCTVAGGSITSSDYFWGWLRQSPGKGLEWIASTYHGGSIQYHPALKSRVTISVDASKNQISLRLSSVTAADTAVYYCARDRGDDGPMGTYYFDHWGQGALVTVSS

SEQ ID NO: 1032 - protein, 109 aa, Homo sapiens
QSVLTQPPSVSGAPGQSVTISCAGSSSNIGAGHDVHWYQQIPGTAPKLLICGNTNRPSGVPERFSGSRSGTSASLAITGLQAEDEAVYYCQSYDPSHVFFGTGTKLTVL

SEQ ID NO: 1033 - protein, 129 aa, Homo sapiens
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARERKVVVAATRNYYYYYGMDVWGQGTTVTVSS

SEQ ID NO: 1034 - protein, 106 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSTWVFGGGTKLTVL

SEQ ID NO: 1035 - protein, 127 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDPTEVGATSEYYYYGMDVWGQGTTVTVSS

SEQ ID NO: 1036 - protein, 108 aa, Homo sapiens; identical to SEQ ID NO: 758

SEQ ID NO: 1037 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPNSGSYFGYFQHWGQGTLVTVSS

SEQ ID NO: 1038 - protein, 112 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGFYVFGTGTKVTVL

SEQ ID NO: 1039 - protein, 116 aa, Homo sapiens
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDKSSGSGPWGQGTLVTVSS

SEQ ID NO: 1040 - protein, 107 aa, Homo sapiens; identical to SEQ ID NO: 730

SEQ ID NO: 1041 - protein, 123 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCAIELLEGFYYYYGMDVWGQGTTVTVSS

SEQ ID NO: 1042 - protein, 110 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYPYVVFGGGTKLTVL

SEQ ID NO: 1043 - protein, 127 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRVYDYIWGSYRYFDYWGQGTLVTVSS

SEQ ID NO: 1044 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTVVFGGGTKLTVL

SEQ ID NO: 1045 - protein, 122 aa, Homo sapiens
EVQLVESGGGLVQPGGSLRLSCAASEFTFSSYWMSWVRQAPGKGLEWVANIKQDGSEKYYVDSVKGRFTISRDNAKNSLYLQMNSLRAEDTAVYYCARVGEYSGYDLFFDYWGQGTLVTVSS

SEQ ID NO: 1046 - protein, 111 aa, Homo sapiens
NFMLTQPHSVSESPGKTVTISYTGSSGSIASNYVQWYQQRPGSAPTTVIYEDNQRPSGVPDRFSGSIDSSSNSASLTISGLKTEDEADYYCQSYDSSNQGVFGGGTKLTVL

SEQ ID NO: 1047 - protein, 119 aa, Homo sapiens
EVQLVESGGGLVQPGGSLRLSCAASGFTFSTYWMSWVRQAPGKGLEWVANIKQDGSEKYYVDSVKGRFTISRDNAKNSLYLQMNSLRAEDTAVYYCARLGGSSWYFDYWGQGTLVTVSS

SEQ ID NO: 1048 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTGVFGTGTKVTVL

SEQ ID NO: 1049 - protein, 126 aa, Homo sapiens
QVQLVESGGGLVKPGGSLRLSCAASGFTFSDYYLSWIRQAPGKGLEWVSYISSSGSNIYYADSVKGRFTISRDNAKNSLYLQMNSLRADDTAVFYCARAGRYCSGGSCRVEYFQHWGQGTLVTVSS

SEQ ID NO: 1050 - protein, 107 aa, Homo sapiens
SYELTQPPSVSVSPGQTARITCSGDALPKQYAYWYQQKPGQAPVLVIYKDNERPSGIPERFSGSSSGTTATLTISGVQAEDEADYYCQSADSSGTVVFGGGTKLTVL

SEQ ID NO: 1051 - protein, 129 aa, Homo sapiens
QVQLVESGGGVVQPGRSLRLSCAASGFTFSSYAMYWVRQAPGKGLEWVAVISYDGSNKYYADSVKGRFTISRDNSKNTLYLQMNSLRAEDTAVYYCARDRPHYYGSGRKILNLYGMDVWGQGTTVTVSS

SEQ ID NO: 1052 - protein, 108 aa, Homo sapiens
DIQLTQSPSFLSASVGDRVTITCRASQGISSYLAWYQQKPGKAPKLLIYAASTLQSGVPSSFSGSGSGTEFTLTISSLQPEDFATYYCQQLNSYPPFTFGPGTKVDIK

SEQ ID NO: 1053 - protein, 128 aa, Homo sapiens
QVQLVQSGAEVKKPGASLKVSCKASGYIFTGYYMHWVRQAPGQGLEWMGWISPNSGGTKYAQKFQGRVTMTRDTSISTAYMELSRLRSDDSAVYYCAREPYYDILTGYYTPRRYLDYWGQGTLVTVSS

SEQ ID NO: 1054 - protein, 110 aa, Homo sapiens
QSALTQPASVSGSPGQSITISCTGTSSDVGDYNYVSWYQQHPGKVPKLMIYDVSHRPSGVTNRFSGSKSGNTASLTISGLRAEDEADYYCSSYTSSSTYVFGTGTKVTVL

SEQ ID NO: 1055 - protein, 129 aa, Homo sapiens
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCARDSIVVPAAIISGYYYYGMDVWGQGTTVTVSS

SEQ ID NO: 1056 - protein, 111 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGRVFGGGTKLTVL

SEQ ID NO: 1057 - protein, 122 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARDGSGSYYLSYYFDYWGQGTLVTVSS

SEQ ID NO: 1058 - protein, 109 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPSHTFGQGTKLEIK

SEQ ID NO: 1059 - protein, 123 aa, Homo sapiens
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDPSSSSWSYWYFDLWGRGTLVTVSS

SEQ ID NO: 1060 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPFTFGQGTRLEIK

SEQ ID NO: 1061 - protein, 121 aa, Homo sapiens
QVQLVESGGGVVQPGRSLRLSCAASEFTFATYAMHWVRQAPGKGLEWVALISQDGSNKHYADSVKGRFTISRDNSKNTLYLQMNSLRAEGTAIYYCARESLEAAGPPFDYWGQGTLVTVSS

SEQ ID NO: 1062 - protein, 107 aa, Homo sapiens
SYELTQPPSVSVSPGQTATIICSGDKLGEKYASWYQQKPGQSPALVIYQDRKRPSGIPERFSGSNSGNTATLTISGTQAMDEADYYCQAWDSSNSVVFGGGTKLTVP

SEQ ID NO: 1063 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPHSGSYFSYFDYWGQGTLVTVSS

SEQ ID NO: 1064 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLFGQGTKLEIK

SEQ ID NO: 1065 - protein, 121 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAKDLYSGSYSFVDYWGQGTLVTVSS

SEQ ID NO: 1066 - protein, 111 aa, Homo sapiens
QAVVTQEPSLTVSPGGTVTLTCGSSTGAVTSGHYPYWFQQKPGQAPRTLIYETSNKHSWTPARFSGSLLGGKAALTLSGAQPEDEAEYYCLLSYSGARRGVFGGGTKLTVL

SEQ ID NO: 1067 - protein, 125 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCASNPAAGQEAYYYYGMDVWGQGTTVTVSS

SEQ ID NO: 1068 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTVVFGTGTKVTVL

SEQ ID NO: 1069 - protein, 127 aa, Homo sapiens
QVQLVESGGGVVQPGRSLRLSCAASGFTFSSYGMHWVRQAPGKGLEWVAVIWYDGNNKYYADSVKGRFTISRDNSKNTLYLQMNSLRAEDTAVYYCAKDPTWFGELPSYYYYGMDVWGQGTTVTVSS

SEQ ID NO: 1070 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPPITFGQGTRLEIK

SEQ ID NO: 1071 - protein, 121 aa, Homo sapiens
QVQLVESGGGVVQPGRSLRLSCVASGFTFSSYAMHWVRQAPGKGLEWVAVISYDGSNKYYADSVKGRFTISRDNSKNTLYLQMNSLRAEDTAVYYCARDRVGGYSYLFDYWGQGTLVTVSS

SEQ ID NO: 1072 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIK

SEQ ID NO: 1073 - protein, 121 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATARAFGVANWFDPWGQGTLVTVSS

SEQ ID NO: 1074 - protein, 111 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLYVFGTGTKVTVL

SEQ ID NO: 1075 - protein, 125 aa, Homo sapiens
QITLKESGPTLVKPTQTLTLTCTFSGFSLSTSGVGVGWIRQPPGKALEWLALIYWDDDKHYSPSLKSRLTITKDTSKNQVVLTMTNMDPVDTATYYCAHMYYDILSGYYYGMDVWGQGTTVTVSS

SEQ ID NO: 1076 - protein, 111 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGRWVFGGGTKLTVL

SEQ ID NO: 1077 - protein, 123 aa, Homo sapiens
EVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAKDISPIVGATLGMDVWGQGTTVTVSS

SEQ ID NO: 1078 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGGGTKVEIK

SEQ ID NO: 1079 - protein, 127 aa, Homo sapiens
QVQLVQSGAEVKKPGASVKVSCKASGYTFISYGISWVRQAPGQGLEWMGWISAYNGNTNYAQKLQGRVTMTTDTSTSTAYMELRSLRSDDTAVYYCARGLWPGYYYGSGSYSAFHIWGQGTMVTVSS

SEQ ID NO: 1080 - protein, 109 aa, Homo sapiens
QSALTQPPSASGSPGQSVSISCTGTSSDVGGYNYVSWYQQHPGKAPKLMIYEVSKRPSGVPDRFSGSKSGNTASLTVSGLQAEDEADYYCSSYAGSNKVFGGGTKLTVL

SEQ ID NO: 1081 - protein, 124 aa, Homo sapiens
QVQLVESGGGVVQPGRSLRLSCAASGFTFSIYAMHWVRQAPGKGLEWVAVISYDGSNKYYADSVKGRFTISRDNSKNTLYLQMNSLRAEDTAVYYCAGSLPAGSYYYYYGMDVWGQGTTVTVSS

SEQ ID NO: 1082 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADNSGTYVLFGGGTKLTVL

SEQ ID NO: 1083 - protein, 120 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDLLSVGWSFDYWGQGTLVTVSS

SEQ ID NO: 1084 - protein, 108 aa, Homo sapiens; identical to SEQ ID NO: 758

SEQ ID NO: 1085 - protein, 128 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARLQGYSGYDYRGDYYYGMDVWGQGTTVTVSS

SEQ ID NO: 1086 - protein, 110 aa, Homo sapiens; identical to SEQ ID NO: 692

SEQ ID NO: 1087 - protein, 127 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKQYSPYCSGGSCYSGASDYWGQGTLVTVSS

SEQ ID NO: 1088 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPQTFGQGTKLEIK

SEQ ID NO: 1089 - protein, 113 aa, Homo sapiens
EVQLVESGGGLIQPGGSLRLSCAASGFTVSSNYMSWVRQAPGKGLEWVSVIYSGGTTHYADSVKGRFTISRDNSKNTLYLQMNSLRAEDTAVYYCANYGMDVWGQGTTVTVSS

SEQ ID NO: 1090 - protein, 104 aa, Homo sapiens
SYELTQPSSVSVSPGQTARITCSGDVLAKKYARWFQQKPGQAPVLVIYKDSERPSGIPERFSGSSSGTTVTLTISGAQVEDEADYYCYSAADKVFGGGTKLTVL

SEQ ID NO: 1091 - protein, 126 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARESVEYSGYEYYYYGMDVWGQGTTVTVSS

SEQ ID NO: 1092 - protein, 108 aa, Homo sapiens; identical to SEQ ID NO: 716

SEQ ID NO: 1093 - protein, 125 aa, Homo sapiens
EVQLVESGGGLVQPGGSLRLSCAASGFTFSSYWMHWVRQAPGKGLVWVSRINSDGSSTSYADSVKGRFTISRDNAKNTLYRQMNSLRAEDTAVYYCALGPLDIVGSYYYYGMDVWGQGTTVTVSS

SEQ ID NO: 1094 - protein, 112 aa, Homo sapiens; identical to SEQ ID NO: 928

SEQ ID NO: 1095 - protein, 124 aa, Homo sapiens
QVQLVESGGGVVQPGRSLRLSCAASGFTFSSYAMHWVRQAPGKGLEWVTFISHEGSNKYYADSVKGRFTISRDNSKNTLYLQMNSLRAEDTAVYYCARTFEYSSSSATGDFDYWGQGTLVTVSS

SEQ ID NO: 1096 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVVFGGGTKLTVL

SEQ ID NO: 1097 - protein, 125 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKAEDTGVYYCARDHELPNSSSWFGHFEYWGQGTLVTVSS

SEQ ID NO: 1098 - protein, 108 aa, Homo sapiens
SYELTQPPSVSVSPGQTARITCSGDALPKQYAYWYQQKAGQAPVLVIYKDSERRSGIPERFSGSSSGTTVTLTISGVQAEDEADYYCQSADSSGTSVVFGGGTKLTVL

SEQ ID NO: 1099 - protein, 131 aa, Homo sapiens
QVQLVESGGGVVQPGRSLRLSCAASGITFSSYAMHWVRQAPGKGLEWVAVISYDGSDKYHADSVKGRFAISRDNSKNTLYLQMNSLRAEDTAVYYCAKDKGIAVAGTGWIRPDPEYYFDYWGQGTLVTVSS

SEQ ID NO: 1100 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPVFGQGTKVEIK

SEQ ID NO: 1101 - protein, 123 aa, Homo sapiens
QVQLVESGGGVVQPGRSLRLSCAASGFTFSSYAMHWVRQAPGKGLEWVAVISYDGRNKYYADSVKGRFTISRDNSKNTLYLQMNSLRAEDTAVYYCARPWGSMVRGVTYFDYWGQGTLVTVSS

SEQ ID NO: 1102 - protein, 108 aa, Homo sapiens
EIVLTQSPGTLSLSPGERATLSCRASQSVSSSYLAWYQQKPGQAPRLLIYDASSRATGIPDRFSGSGSGTDFTLTISRLEPEDFAVYYCQQYGSSPITFGQGTRLEIK

SEQ ID NO: 1103 - protein, 128 aa, Homo sapiens
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDLGARTPWDIVVVPAAMDYWGQGTLVTVSS

SEQ ID NO: 1104 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPNTFGQGTKLEIK

SEQ ID NO: 1105 - protein, 121 aa, Homo sapiens
QVQLVESGGGVVQPGRSLRLSCAASGFTFSSYAMHWVRQAPGKGLEWVAVISYDGNNKYYADSVKGRFTISRDNSKNTLYLQMNSLRAEDTAVYYCVRTNSGSYYAAFDYWGQGTLVTVSS

SEQ ID NO: 1106 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 1107 - protein, 116 aa, Homo sapiens
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCAREVAGTYDYWGQGTLVTVSS

SEQ ID NO: 1108 - protein, 108 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPGGTFGPGTKVDIK

SEQ ID NO: 1109 - protein, 120 aa, Homo sapiens
EVQLVESGGGLVQPGGSLRLSCAASGFTFSSYWMTWVRQAPGKGLEWVANIKQDGSEKYYVDSVKGRFTISRDNAKNSLYLQMNSLRAEDTAVYYCARGVGSWYLGFDYWGQGTLVTVSS

SEQ ID NO: 1110 - protein, 110 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDGSSYVFGTGTKVTVL

SEQ ID NO: 1111 - protein, 128 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARAPEEKSSEIGELVGWGWFDPWGQGTLVTVSS

SEQ ID NO: 1112 - protein, 106 aa, Homo sapiens
SYELTQPPSVSVSPGQTASIICSGDKLGDKYACWYQQKPGQSPVLVIYQDSKRPSGIPERFSGSNSGNTATLTISGTQAMDEADYYCQAWDSSTVVFGGGTKLTVL

SEQ ID NO: 1113 - protein, 123 aa, Homo sapiens
EVQLLESGGGLVQPGGSLRLSCAASGFTFSSYAMSWVRQVPGKGLEWVSGISGSGGSTYYADSVKGRFTISRDNSKNTLYLQMNSLRAEDTAVYYCAKHGERYSSLGYYFDYWGQGTLVTVSS

SEQ ID NO: 1114 - protein, 107 aa, Homo sapiens; identical to SEQ ID NO: 722

SEQ ID NO: 1115 - protein, 123 aa, Homo sapiens
QVQLQESGPGLVKPSGTLSLTCAVSGASISSSNWWSWVRQPPGKGLEWIGEIYHSGSTNYNPSLKSRVTISVDKSKNQFSLKLSSVTAADTAVYYCARRSYYGSGSYYPFDYWGQGTLVTVSS

SEQ ID NO: 1116 - protein, 110 aa, Homo sapiens
QSALTQPASVSGSPGQSITISCTGTSSDVGSYNLVSWYQQHPGKAPKLMIYEGRKRPSGVSNRFSGSKSGNTASLTISGLQAEDEADYYCCSYAGSSTYVFGTGTKVTVL

SEQ ID NO: 1117 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGSGSYFSWFDPWGQGTLVTVSS

SEQ ID NO: 1118 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQKYGSSITFGPGTKVDIK

SEQ ID NO: 1119 - protein, 127 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGPLDFWSGYFRLRYFDCWGQGTLVTVSS

SEQ ID NO: 1120 - protein, 110 aa, Homo sapiens; identical to SEQ ID NO: 904

SEQ ID NO: 1121 - protein, 115 aa, Homo sapiens
EVQLVESGGGLIQPGGSLRLSCAASGLTVSSNYMSWVRQAPGKGLEWVSVIYSGGSTYYADSVKGRFTISRDNSKNTLYLQMNSLRAEDTAVYYCARSPYGGNSWGQGTLVTVSS

SEQ ID NO: 1122 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 1123 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGSGNYYNWFDPWGQGTLVTVSS

SEQ ID NO: 1124 - protein, 108 aa, Homo sapiens
EIVMTQSPATLSVSPGERATLSCRASQTVSSNLVWYQQKPGQAPRLLIYGASTRATGIPARFSGSGSGTEFTLTISSLQSEDFAVYYCQQYNNWPPYTFGQGTKLEIK

SEQ ID NO: 1125 - protein, 126 aa, Homo sapiens
QVQLQESGPGLVKPSGTLSLTCAVSGGSISSSNWWSWVRQPPGKGLEWIGELYHSGSTNYNPSLKSRVTISVDKSKNQFSLKLSSVTAADTAVYYCARVGPYYYDSSGYYNYFDYWGPGTLVTVSS

SEQ ID NO: 1126 - protein, 109 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPPGITFGQGTRLEIK

SEQ ID NO: 1127 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSRGGSYSNAFDIWGQGTMVTVSS

SEQ ID NO: 1128 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYHLGLTFGGGTKVEIK

SEQ ID NO: 1129 - protein, 122 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGILWWWWGYFDYWGQGTLVTVSS

SEQ ID NO: 1130 - protein, 110 aa, Homo sapiens
QSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSVVFGGGTKLTVL

SEQ ID NO: 1131 - protein, 124 aa, Homo sapiens
EVQLVESGGGLIQPGRSLRLSCAASGFTVSITYMSWVRQAPGKGLEWVSLIYSGGSSYYADSVKGRFTISRDNSKNTLYLQMNSLRAEDTAVYYCATTMVRGVIISYYYGMDVWGQGTTVTVSS

SEQ ID NO: 1132 - protein, 110 aa, Homo sapiens; identical to SEQ ID NO: 926

SEQ ID NO: 1133 - protein, 117 aa, Homo sapiens
EVQLVESGGGLVQPGGSLRLSCAASGFTVSSNYMSWVRQAPGKGLEWVSVIYSGGSTFYADSVKGRFTISRDNSKNTLYLQMNSLRAEDTAVYYCARDSGDQLLDYWGQGTLVTVSS

SEQ ID NO: 1134 - protein, 108 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPFTFGPGTKVDIK

SEQ ID NO: 1135 - protein, 124 aa, Homo sapiens
QITLKESGPTLVKPTQTLTLTCTFSGFSLSTSGVGVGWIRQPPGKALEWLALIYWDDDKRYSPSLKSRLTITKDTSKNQVVLIMTNMDPVDTATYYCAHRDSSSWFDLDAFDIWGQGTMVIVSS

SEQ ID NO: 1136 - protein, 110 aa, Homo sapiens
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDRLNGPVFGGGTKLTVL

SEQ ID NO: 1137 - protein, 130 aa, Homo sapiens
QVQLVQSGAEVKKPGASVKVSCKASGYTFTDYYIHWVRQAPGQGLEWMGWINPNSGGTNYAQKFQGRLTMTRDTSISTAYMELSRLRSDDTAVYYCARVYSMFREFIINPYYYYYGLDVWGQGTTVTVSS

SEQ ID NO: 1138 - protein, 110 aa, Homo sapiens
QSALTQPASVSGSPRQSITISCTGTSSDVGSYNLVSWYQQHPGKAPKLMIYEGSKRPSGVSNRFSGSKSGNTASLAISGLQAEDEANYYCCSYAGSSTLVFGGGTKLTVL

SEQ ID NO: 1139 - protein, 124 aa, Homo sapiens
QVQLQESGPGLVKPSQTLSLTCTVSGGSINSFGYYWSWIRQHPGKGLEWIGYIYYSGSTDYNPSLNSRVTISLDTSKNQFLLKLTSVTAADTAVYYCAKLTDYYDSSGYSFDYWGQGTLVTVSS

SEQ ID NO: 1140 - protein, 107 aa, Homo sapiens
DIQMTQSPSSVSASVGDRVTITCRASQDISRWLAWYQQKPGKAPKLLIYAASSLQSGVPSRFSGRGSGTELTLTISSLQPEDFATYFCQQAYSFPFTFGGGTKVEIK

SEQ ID NO: 1141 - protein, 128 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDGPYGSGRMYFYYYYGMDVWGQGTTVTVSS

SEQ ID NO: 1142 - protein, 112 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTSFVVFGGGTKLTVL

SEQ ID NO: 1143 - protein, 120 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAPAGIVVGPDYWGQGTLVTVSS

SEQ ID NO: 1144 - protein, 112 aa, Homo sapiens
NFMLTQPHSVSESPGKTVTISCTGSSGSIASNYVQWYQQRPGSAPTTVIFEDNQRPSGVPDRFSGSIDSSSNSASLTISGLKTEDEADYYCQSYHSSNPHVVFGGGTKLTVL

SEQ ID NO: 1145 - protein, 119 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKSRDGYKLFDIWGQGTMVTVSS

SEQ ID NO: 1146 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPMYTFGQGTKLEIK

SEQ ID NO: 1147 - protein, 121 aa, Homo sapiens
QVQLVQSGAEVKKPGASVKVSCKASGYTFTSYYVHWVRQAPGQSLEWMGVISPSTGSTTYAQNFQGRVTMTRDTSTTTVYMELSSLRSEDTAVYYCARDDYYDSTRYFDLWGRGTLVTVSS

SEQ ID NO: 1148 - protein, 110 aa, Homo sapiens
QSALTQPASVSGSPGQSISFSCTGTSSDIGAYNYVSWYQQHPGRAPKLMIYDVGNRPSGVSNRFSGSKSGNTASLTISGLQAEDEADYYCSSYTSSSTQVFGTGTKVTVL

SEQ ID NO: 1149 - protein, 127 aa, Homo sapiens
QVQLVQSGAEVKKPGASVKVSCKASGYTFTSYYMHWVRQAPGQGLEWMGIINPSGGSTSYAQKFQGRVTMTRDTATSTVYMELSSLRSEDTAVYYCARGGGQISMIIVVMDDAFDIWGQGTMVTVSS

SEQ ID NO: 1150 - protein, 107 aa, Homo sapiens
EILMTQSPATLSVSPGERATLSCRASQSVSSNLAWYQQKPGQAPRLLIYGASTRATGIPARFSGSGSGTEFTLTISSLQSEDFAVYYCQQYNNWPYTFGQGTKLEIK

SEQ ID NO: 1151 - protein, 128 aa, Homo sapiens
QVQLVQSGAEVRKPGASVKVSCKVSGYTLTELSMHWVRQAPGKGLEWMGGFDPEDGETIYAQKFQGRVTMTEDTSTDTAYMELSSLRSEDTAVYYCATAPAVAGTTKNYYYYYGMDVWGQGTTVTVSS

SEQ ID NO: 1152 - protein, 112 aa, Homo sapiens
DIVMTQTPLSSPVTLGQPASISCRSSQSLVHSDGNTYLSWLQQRPGQPPRLLIYKISNRLSGVPDRFSGSGAGTDFTLKISRVEAEDVGVYYCMQATQFPYTFGQGTKLEIK

SEQ ID NO: 1153 - protein, 128 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKGGGGGYCSGGSCYSHYFDYWGQGTLVTVSS

SEQ ID NO: 1154 - protein, 106 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPTFGPGTKVDIK

SEQ ID NO: 1155 - protein, 127 aa, Homo sapiens
EVQLVESGGGLVKPGGSLRLSCAASGFTFSSYSMNWVRQAPGKGLEWVSSISSSSSYIYYADSVKGRITISRDNAKNSLYLQMNSLRAEDTAVYYCAREYPNFRAEWLLSPYGMDVWGQGTTVTVSS

SEQ ID NO: 1156 - protein, 112 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTSVKVFGTGTKVTVL

SEQ ID NO: 1157 - protein, 119 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHHSLSSIFDYWGQGTLVTVSS

SEQ ID NO: 1158 - protein, 109 aa, Homo sapiens
QSALTQPASVSGSPGQSITISCTGTSSDVGDYNYVSWYQQHPGKAPKLMIYEVSNRPSGVSNRFSGSKSGNTASLTISGLQAEDEADYYCSSYTSSSTVFGGGTKLTVL

SEQ ID NO: 1159 - protein, 118 aa, Homo sapiens
QVQLQESGPGLVKPSGTLSLTCAVSGGSISSSNWWSWVRQPPGKGLEWIGEIYHSGNTNYNPSLKSRVTISVDKSKNQFSLKLSSVTAADTAVYYCARREWLRLFDYWGQGTLVTVSS

SEQ ID NO: 1160 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTYVFGTGTKVTVL

SEQ ID NO: 1161 - protein, 127 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCAVENMITFGGVIVKRGAFDIWGQGTMVTVSS

SEQ ID NO: 1162 - protein, 108 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPLFTFGPGTKVDIK

SEQ ID NO: 1163 - protein, 120 aa, Homo sapiens
QVQLVESGGGVVQPGRSLRLSCAASGFNLSSYAMHWVRQASGKGLEWVSLISYDGSIKYYTDSVKGRFTVSGDNSKNTLFLQMNSLRADDSALYYCVRGGVSGPNSFDLWGQGTTVTVSS

SEQ ID NO: 1164 - protein, 112 aa, Homo sapiens; identical to SEQ ID NO: 876

SEQ ID NO: 1165 - protein, 120 aa, Homo sapiens
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCAREGQWLYRFDYWGQGTLVTVSS

SEQ ID NO: 1166 - protein, 110 aa, Homo sapiens
QSALTQPASVSGSPGQSITISCTGTSSDVGNYDLVSWYQQHPGKAPKLVIYGVTKRPSGVSNRFSGSKSGNTASLTISGLQAEDEADYYCCSYATGDTSVFGTGTKVTVL

SEQ ID NO: 1167 - protein, 126 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCASEKVDFWSGGPYYGMDVWGQGTTVTVSS

SEQ ID NO: 1168 - protein, 110 aa, Homo sapiens
QSALTQPASVSGSPGQSITISCTGTSSDVGSYNYVSWYQQHPGKAPKLMIYEVSNRPSGVSNRFSGSKSGNTASLTISGLQAEDEADYYCSSYTSISTLVFGGGTKLTVL

SEQ ID NO: 1169 - protein, 128 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEGDCTGGVCYTYYFDYWGQGTLVTVSS

SEQ ID NO: 1170 - protein, 108 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTASVVFGGGTKLTVL

SEQ ID NO: 1171 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGSGSYYNWFDPWGQGTLVTVSS

SEQ ID NO: 1172 - protein, 111 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTPYVFGTGTKVTVL

SEQ ID NO: 1173 - protein, 131 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDCKYDILTGHYSAGYYYYGMDVWGQGTTVTVSS

SEQ ID NO: 1174 - protein, 107 aa, Homo sapiens
DIQMTQSPSSLSASVGDRVTITCRASQGISNYLAWFQQKPGKAPKSLIYAASSLQSGVPSKFSGSGSGTDFTLTISSLQPEDFATYYCQQYNSYPFTFGGGTKVEIK

SEQ ID NO: 1175 - protein, 124 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCASIAAAGTLYYYYGMDVWGQGTTVTVSS

SEQ ID NO: 1176 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSNVVFGGGTKLTVL

SEQ ID NO: 1177 - protein, 124 aa, Homo sapiens
QVELQQWGAGLLKPSETLSLTCAVYGGSFSGYYWSWIRQPPGKGLEWIGEINHSGSTNYNPSLKSRVTISIDTSKNQFSLKLSSVTAADTAVYYCARGTTVTTFFAPHWYFDLWGRGTLVTVSS

SEQ ID NO: 1178 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPYVFGTGTKVTVL

SEQ ID NO: 1179 - protein, 120 aa, Homo sapiens
QVQLVESGGGVVQPGRSLRLSCAASGFNLSNYAMHWVRQASGKGLEWVSLISYDGSIKYYTDSVKGRFTVSGDNSKNTLFLQMNSLRADDSALYYCVRGGVSGPNSFDMWGQGTTVTVSS

SEQ ID NO: 1180 - protein, 112 aa, Homo sapiens; identical to SEQ ID NO: 678

SEQ ID NO: 1181 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKPYSGSYWDAFDIWGQGTMVTVSS

SEQ ID NO: 1182 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVEIK

SEQ ID NO: 1183 - protein, 119 aa, Homo sapiens
QVQLVESGGGVVQPGRSLRLSCAASGFTFNSYAMHWVRQAPGKELEWVAVISYDGSNKYYADSVKGRFTISRDNSKNTLYLQMNSLRAEDTAVYYCARGGGGYRYIDYWGQGTPVTVSS

SEQ ID NO: 1184 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPSYTFGQGTKLEIK

SEQ ID NO: 1185 - protein, 124 aa, Homo sapiens
QVQLVESGGGVVQPGRSLRLSCAASGFTFSSYAMHWGRQAPGKGLEWVAVISYDGSNKYYADSVKGRFTISRDNSKNTLYLQMNSLRAEDTAVYYCARDGGSGWLLVGNWFDPWGQGTLVTVSS

SEQ ID NO: 1186 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSITLYVFGTGTKVTVL

SEQ ID NO: 1187 - protein, 128 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREGNDYGDYGEWELLGYFDYWGQGTLVTVSS

SEQ ID NO: 1188 - protein, 109 aa, Homo sapiens
SYELTQPPSVSVSPGQTARITCSGDALPKKYAYWYQQKSGQAPVLVIYEDSKRPSGIPERFSGSSSGTMATLTISGAQVEDEADYYCYSTDSSGNHRRVFGGGTKLTVL

SEQ ID NO: 1189 - protein, 126 aa, Homo sapiens
EVQLVESGGGLVQPGGSLRLSCAASGFNFSSYSMNWVRQAPGKGLEWVSYISSSSSTIYYADSVKGRFTISRDNAKNSLYLQMNSLRDEDTAVYYCARGPEWDIVVVQAENWFDPWGQGTLVTVSS

SEQ ID NO: 1190 - protein, 109 aa, Homo sapiens
SYELTQPPSVSVSPGQTARITCSGDALPKQYVYWYQQKPGQAPVLVIYKDSERPSGIPERFSGSSSGTTVTLTISGVQAEDEADYYCQSADSSGTYRGVFGGGTKLTVL

SEQ ID NO: 1191 - protein, 116 aa, Homo sapiens
EVQLVESGGVSVQPGGSLRLSCAASGFSFNTYDMHWVRQGTGKGLEWVSGIGTAGDTYYSDSVKGRCTISRDNAKNSLHLLVKSVRAADTAVYYCARGVGGIIDYWGQGTLVTVSS

SEQ ID NO: 1192 - protein, 110 aa, Homo sapiens
NFVLSQPHSVSESPGKTVTISCTGNSGSIATKYVQWFQQRPGSAPTTVIYEDNQRPSGVPDRFSGSSDSSSNSASLTISGLKTEDEAHYYCQSYHNRRWVFGGGTKLTVL

SEQ ID NO: 1193 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKAGGGSYYRGFDYWGQGTLVTVSS

SEQ ID NO: 1194 - protein, 110 aa, Homo sapiens
QSVLTQPPSVSAAPGQKVTISCSGSNSNIGNNYVSWYQQLPGSAPKLLIYDNDKRPSGIPDRFSGSKSGTSATLGITGLQTGDEADYYCGAWDSSLTALVFGGGTKLTVL

SEQ ID NO: 1195 - protein, 121 aa, Homo sapiens
QVQLVESGGGVVQPGRSLRLSCAASGFTFSSYAMHWVRQAPGKGLEWVTVISYNGRNKYYADSVKGRFTISRDNSKNTLYLQMNSLRAEDTAVYWCAREGLGAIVVGLDYWGQGTLVIVSS

SEQ ID NO: 1196 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSTTVVFGGGTKLTVL

SEQ ID NO: 1197 - protein, 124 aa, Homo sapiens
QVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCARDNLGYDFWSGSWFDPWGQGTLVTVSS

SEQ ID NO: 1198 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 1199 - protein, 124 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAMYYCASHVVVIASSYWCFDLWGRGTLVTVSS

SEQ ID NO: 1200 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSISTWVFGGGTKLTVL

SEQ ID NO: 1201 - protein, 124 aa, Homo sapiens
QVQLVQSGAEVKKPGSSVKVSCKASGGTFNSNSISWVRQAPGQGLEWMGRIIPILDITMYARKFQGRVTISADKSTGTAYMDLSSLRSEDTAVYYCATDRDDSSGDYYYGMDVWGQGTTVTVSS

SEQ ID NO: 1202 - protein, 107 aa, Homo sapiens
DIQMTQSPSSLSASVGDRVTITCRASLSISNYLNWYQQKPGKAPNLLIYAASTLQSGVPSRFSGSGSGTDFTLTISSLQPEDFATYYCQQTYITRWTFGQGTKVEIK

SEQ ID NO: 1203 - protein, 126 aa, Homo sapiens; identical to SEQ ID NO: 769

SEQ ID NO: 1204 - protein, 107 aa, Homo sapiens
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPHTFGGGTKVEIK

SEQ ID NO: 1205 - protein, 121 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAREPQLWSEYYFDYWGQGTLVTVSS

SEQ ID NO: 1206 - protein, 107 aa, Homo sapiens
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTRLEIK

SEQ ID NO: 1207 - protein, 123 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARSLGWFGELLSWFDPWGQGTLVTVSS

SEQ ID NO: 1208 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPGTFGQGTKVEIK

SEQ ID NO: 1209 - protein, 120 aa, Homo sapiens
EVQLVESGGGLVQPGGSLRLSCAASGIIVSSNYMSWVRQAPGKGLEWVSVIYSGGSTYYADSVKGRFTISRDNSKNTLYLQMNSLRAEDTAVYYCAREGLVGATLAFDYWGQGTLVTVSS

SEQ ID NO: 1210 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPGTFGQGTKVEIK

SEQ ID NO: 1211 - protein, 122 aa, Homo sapiens
GVQLVESGGVVVQPGGSLRLSCAASGFSFDDYTMHWVRQAPGKGLEWVSLVSWDGGTTYYTDSVKGRFTISRDNSKNSLYLQMNSLRTEDTALYFCAKDSGRIVPAATFDYWGQGTLVTVSS

SEQ ID NO: 1212 - protein, 107 aa, Homo sapiens
DIQMTQSSSSLSASVGDRVTITCRASQDISNYLAWFQQKPGKAPKSLIYAASSLQSGVPSKFSGSGSGTDFTLTISSLQPEDFATYYCQQYYTYPLTFGGGTKVEIK

SEQ ID NO: 1213 - protein, 130 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARASPYYYDSSGYFLPPYYFDYWGQGTLVTVSS

SEQ ID NO: 1214 - protein, 107 aa, Homo sapiens; identical to SEQ ID NO: 858

SEQ ID NO: 1215 - protein, 132 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLTEEGDFWSASSYRRYYYYGMDVWGQGTTVTVSS

SEQ ID NO: 1216 - protein, 107 aa, Homo sapiens
SYELTQPPSVSVSPGQTASITCSGDKLGDKYACWYQQKPGQSPVLVIYQDSKRPSGIPERFSGSNSGNTATLTIRGTQAMDEADYYCQAWDSSTAYVFGTGTKVTVL

SEQ ID NO: 1217 - protein, 128 aa, Homo sapiens
QVQLVESGGGVVQPGRSLRLSCAASGFTFSSYVMHWVRQAPGKGLEWVALISYDGSNKYYADSVKGRFTISRDNSKNTLYLQMNSLRAEDTAVYYCARGGHIRVGRYFDWLISYFDYWGQGTLVTVSS

SEQ ID NO: 1218 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYLTFGQGTKVEIK

SEQ ID NO: 1219 - protein, 120 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGLYYDMGGGFDYWGQGTLVTVSS

SEQ ID NO: 1220 - protein, 108 aa, Homo sapiens; identical to SEQ ID NO: 758

SEQ ID NO: 1221 - protein, 118 aa, Homo sapiens
QLQLQESGPGLVKPSETLSLTCTVSGGSISSSSYYWGWIRQPPGKGLEWIGSINYSGSTYYNPSLKSRVTISVDTSKNQFSLKLSSVTAADTAVYYCARYHDYGDDYWGQGTLVTVSS

SEQ ID NO: 1222 - protein, 111 aa, Homo sapiens
QLVLTQSPSASASLGASVKLTCTLSSGHSRYAIAWHQQQPEKGPRYLMKLNSDGSHSKGDGIPDRFSGSSSGAERYLTISSLQSEDEADYYCQTWGTGIQVFGGGTKLTVL

SEQ ID NO: 1223 - protein, 124 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCASIAAAGPNTLQYYGMDVWGQGTTVTVSS

SEQ ID NO: 1224 - protein, 106 aa, Homo sapiens; identical to SEQ ID NO: 712

SEQ ID NO: 1225 - protein, 118 aa, Homo sapiens
EVQLVESGGGLVKPGGSLRLSCAASGFTFSNAWMSWVRQAPGKGLEWVGHIKSKTDGGTTDYAAPVKGRFTISRDDSKNTLYLQMNSLKTEDTAVYYCTREPYYFDYWGQGTLVTVSS

SEQ ID NO: 1226 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYRYTFGQGTKLEIK

SEQ ID NO: 1227 - protein, 121 aa, Homo sapiens; identical to SEQ ID NO: 1147

SEQ ID NO: 1228 - protein, 110 aa, Homo sapiens
DIVMTQSPDSLAVSLGERATINCKSSQSVLYRSNNKNCLAWYQQKPGRPPKLLIYWASTRESGVPDRFSVSGSGTDFTLTISSLQAEDVAVYYCQQYYTFFGPGAKVDIK

SEQ ID NO: 1229 - protein, 112 aa, Homo sapiens; identical to SEQ ID NO: 1001

SEQ ID NO: 1230 - protein, 108 aa, Homo sapiens
EIVLTQSPGTLSLSPGERATLSCRASQSVSIIYLAWYQQKPGQAPRLLIYGASSRATGIPDRFSGSGSGTDFTLTISRLEPEDFAVYYCQQYGSSLWTFGQGTKVEIK

SEQ ID NO: 1231 - protein, 130 aa, Homo sapiens
EVQLVESGGGLVQPGRSLRLSCAASGFTFHDYAMHWVRQAPGKGLEWVSGISWNSGSIGYADSVKGRFTISRDNAKNSLYLQMNSLRAEDTALYYCAKDTFGSSSWYRGDSYYYYGMDVWGQGTTVTVSS

SEQ ID NO: 1232 - protein, 113 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTQRYVVFGGGTKLTVL

SEQ ID NO: 1233 - protein, 118 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGFKWFGELLFGAQGTLVTVSS

SEQ ID NO: 1234 - protein, 110 aa, Homo sapiens; identical to SEQ ID NO: 946

SEQ ID NO: 1235 - protein, 125 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISVLKAEDTGVYYCARDHELPNSSSWFGHFEYWGQGTLVTVSS

SEQ ID NO: 1236 - protein, 108 aa, Homo sapiens; identical to SEQ ID NO: 1098

SEQ ID NO: 1237 - protein, 123 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARNCGGDCVAGDGFDYWGQGTLVTVSS

SEQ ID NO: 1238 - protein, 108 aa, Homo sapiens
DIQMTQSPSSLSASVGDRVTITCRASQSISSYLNWYQQKPGKAPNLLIYAASSLQSGVPSRFSGSGSGTDFTLTISSLQPEDFATYYCQQSYSALTWTFGQGTKVEIK

SEQ ID NO: 1239 - protein, 120 aa, Homo sapiens
QVHLVESGGGVVQPGRSLRLSCAASGFALSSYAMHWVRQPPGKGLEWVALISYDGSVKKYADSVKGRITVSGDNSRNTLHLQINSLRADDTAVYYCVRGGVSGPNSFDLWGHGTMVTVSS

SEQ ID NO: 1240 - protein, 112 aa, Homo sapiens
DVVLTQSPLSLPVTLGQPASISCRSSQSLEYSVGNTYVNWFQQRPGQSPRRLIYKVSNRDSGVPDRFSGSGSGTDFTLQISRVEADDVGIYYCMQGTHWPVTFGQGTKVEIK

SEQ ID NO: 1241 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNNLRAEDTAVYYCAKSGSGSYLSAFDIWGQGTMVTVSS

SEQ ID NO: 1242 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSPWTFGQGTKVEIK

SEQ ID NO: 1243 - protein, 115 aa, Homo sapiens; identical to SEQ ID NO: 1121

SEQ ID NO: 1244 - protein, 107 aa, Homo sapiens
DIQMTQSPSSLSASVGDRVTITCRTSQTIYNYLNWYQQKPGKAPKFLIYAASSFQNGVPSRFSGSGSGTDFTFTISSLQPEDFATYYCQQGYSTPLTFGGGTKVEIK

SEQ ID NO: 1245 - protein, 119 aa, Homo sapiens
QVQLQQWGAGLLKPSETLSLTCAVYGGSFSGYYWSWIRQPPGKGLEWIGEINHSGSTNYTPSLKSRVTISVDTSKNQFSLKLSSVTAADTAVYYCARGWGNRKYGMDVWGQETTVTVSS

SEQ ID NO: 1246 - protein, 108 aa, Homo sapiens
EIVLTQSPGTLSLSPGERATLSCRASLSVSSRYLAWYQQKPGQAPRLLIYGASSRATGVPDRFSGSGSGTDFTLTISRLEPEDFAVYYCQQHGSSPLTFGGGTKVEIK

SEQ ID NO: 1247 - protein, 121 aa, Homo sapiens
EVQLVESGGGLVQPGGSLRLSCAASGFTFSSYWMSWVRQAPGKGLEWVANINQDGSDKYYVDSVKGRFTISRDNAKNSLYLQMNSLRAEDTAVYYCARAPGWAAAPTFDYWGQGTLVTVSS

SEQ ID NO: 1248 - protein, 111 aa, Homo sapiens
QSALTQPRSVSGSPGQSVTISCTGTSSDVGGYNYVSWYQQHPGKAPKFMIYDVSKRPSGVPDRFSGSKSGNTASLTISGLQAEDEADYYCCSYAGSYTLVVFGGGTKLTVL

SEQ ID NO: 1249 - protein, 127 aa, Homo sapiens
QVQLVQSGAEVKKPGSSVKVSCKASGGTFSSYGISWVRQAPGQGLEWMGRIIPILGIANYAQKFQGRVTITADKSTSTAYMELSSLRSEDTAVYYCARAVYAAGDDDYYYYYGMDVWGQGTTVTVSS

SEQ ID NO: 1250 - protein, 108 aa, Homo sapiens
SYELTQPPSVSVSPGQTARITCSGDALPKQYAYWYQQKPGQAPVVVIYKDSDRPSGIPERFSGSSSGTTVTLTISGVQAEDEADYYCQSADSSGTYQVFGTGTKVSVL

SEQ ID NO: 1251 - protein, 122 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDRGYAATFGVFDYWGQGTLVTVSS

SEQ ID NO: 1252 - protein, 107 aa, Homo sapiens
DIQMTQSPSSLSASVGDRVTITCRASQSISSYLNWYQQKPGKAPKLLISAASSLQSGVPSRFSGSGSGTDFTLTISSLQPEDFATYYCQQSYSTAFTFGPGTKVDIK

SEQ ID NO: 1253 - protein, 122 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPQGGNYYYYGMDVWGQGTTVTVSS

SEQ ID NO: 1254 - protein, 107 aa, Homo sapiens; identical to SEQ ID NO: 748

SEQ ID NO: 1255 - protein, 125 aa, Homo sapiens
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSS

SEQ ID NO: 1256 - protein, 107 aa, Homo sapiens
DIQMTQSPSSLSASVGDRVTITCRASQSISSYLSWYQQKPGKAPKLLIYAASSLQSGVPSRFSGSGSGTDFTLTITSLQPEDFATYYCQQSYSTPRTFGQGTKVEIK

SEQ ID NO: 1257 - protein, 121 aa, Homo sapiens
QVQLVESGGGVVQPGRSLRLSCAASGFTFSSYAMHWVRQAPGKGLEWVAVISYDGSDKYYADSVKGRVTISRDNSKNTLYLQMNSLRVEDTAVFYCAKDDCSGGVCFPDYWGQGTLVTVSS

SEQ ID NO: 1258 - protein, 110 aa, Homo sapiens
QSALTQPASVSGSPGQSITISCTGTSSDVGGYNYVSWYQQHPGKAPKLMIYEVSIRPSGVSNRFSGSKSGNTASLTISGLQAEDEAAYYCSSYTSSSTLVFGGGTKLTVL

SEQ ID NO: 1259 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARMYSGSYRGGFDYWGQGTLVTVSS

SEQ ID NO: 1260 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPITFGQGTRLEIK

SEQ ID NO: 1261 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQGGGYYYGMDVWGQGTTVTVSS

SEQ ID NO: 1262 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLYVFGTGTKVTVL

SEQ ID NO: 1263 - protein, 124 aa, Homo sapiens
QVQLQESGPGLVKLSETLSLTCTVSGYSISSGYYWGWIRQPPGKGLEWIGSIYHSGSTYYNPSLKSRVTISVDTSKNQFSLKLSSVTAADTAVYYCAREETLGSSWYESYIDYWGQGTLVTVSS

SEQ ID NO: 1264 - protein, 109 aa, Homo sapiens; identical to SEQ ID NO: 768

SEQ ID NO: 1265 - protein, 122 aa, Homo sapiens
EVQLVESGGGLVQPGGSLRLSCAASGFTISSNYMSWVRQAPGKGLEWVSVIYSGGSTYYADSVKGRFTISRDNSKNTLYLQMNSLRAEDTAVYYCAREEGEWEKDYYGMDVWGQGTTVTVSS

SEQ ID NO: 1266 - protein, 108 aa, Homo sapiens; identical to SEQ ID NO: 742

SEQ ID NO: 1267 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPLSGSYRSAFDIWGQGTMVTVSS

SEQ ID NO: 1268 - protein, 108 aa, Homo sapiens; identical to SEQ ID NO: 1024

SEQ ID NO: 1269 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASSGGYQGPFDPWGQGTLVTVSS

SEQ ID NO: 1270 - protein, 112 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLYVFGTGTKVTVL

SEQ ID NO: 1271 - protein, 121 aa, Homo sapiens
QVQLVESGGGVVQPGRSLRLSCAASGFTFSSYAMHWVRQAPGKGLEWVAVISDDGSNKYYADSVKGRFTISRDNSKNTLYLQMNSLRAEDTAVYYCARDIVATIRRLFDYWGQGTLVTVSS

SEQ ID NO: 1272 - protein, 113 aa, Homo sapiens; identical to SEQ ID NO: 834

SEQ ID NO: 1273 - protein, 118 aa, Homo sapiens
QVHLVESGGGVVQPGKSLRLSCAASGFIFSSFGMHWVRQPPGKGLEWLAVVSYDGSVTKYSDSFEGRFTISRDNSKNTLYLQMDSLRPEDTAVYYCAKGQGTNLLHYWGQGILVTVSS

SEQ ID NO: 1274 - protein, 112 aa, Homo sapiens
DVVLSQSPLSLPVTLGQPASISCRSSESLVYTDGDTYLHWFHQRPGQSPRRLIFKVSHRESGVPDRISGSGSGTDFTLKISRVEAEDVGVYYCMQGTHWPFTFGPGTKVDIK

SEQ ID NO: 1275 - protein, 124 aa, Homo sapiens
EVQLVESGGGLVQPGGSLRLSCTASGFTLSDHYMDWVRQAPGKGLEWVARTRNKVNSYSTEYAASVKGRFSMSRDDSKNSLYLQMTRLQTDDTAVYYCARSLMILGARGASDYWGQGTLVTVSS

SEQ ID NO: 1276 - protein, 107 aa, Homo sapiens
DIQMTQSPSTLSASAGDRVTITCRASQNIDSWLAWYQQHPGKAPNLLIYKASFLQSGVPSRFSGSGSGTEFTLTISSLQPDDFATYYCQQYNSYPVTFGQGTRLEIK

SEQ ID NO: 1277 - protein, 124 aa, Homo sapiens
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDLGVAVTLHPADFDYWGQGTLVTVSS

SEQ ID NO: 1278 - protein, 111 aa, Homo sapiens
QSVLTQPPSVSGAPGQRVTISCTGSSSNIGAGYDVHWYQQLPGTAPKLLIYDNSNRPSGVPDRFSGSKSGTSASLAITGLQAEDEADYYCQSYDSSLSAVVFGGGTKLTVL

SEQ ID NO: 1279 - protein, 119 aa, Homo sapiens
QVQLVESGGGVVQPGRSLRLSCAASGFTFSNYAMHWVRQAPGKGLEWVAVISYDGSHEYYADSVKGRFTISRDNSKNTLYLQMNSLRAEDTAIYYCARGGGGYKFFDYWGQGTLVTVSS

SEQ ID NO: 1280 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPSYTFGQGTKLEIK

SEQ ID NO: 1281 - protein, 125 aa, Homo sapiens
EVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAKDIGYSSTTTEVGWFDPWGQGTLVTVSS

SEQ ID NO: 1282 - protein, 107 aa, Homo sapiens; identical to SEQ ID NO: 748

SEQ ID NO: 1283 - protein, 121 aa, Homo sapiens; identical to SEQ ID NO: 1269

SEQ ID NO: 1284 - protein, 104 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSSPFGPGTKVDIK

SEQ ID NO: 1285 - protein, 120 aa, Homo sapiens; identical to SEQ ID NO: 1165

SEQ ID NO: 1286 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTVIFGGGTKLTVL

SEQ ID NO: 1287 - protein, 117 aa, Homo sapiens
EVQLVESGGGLVQPGGSLRLSCAASGFTFSTYWMTWVRQAPGKGLEWVANIKHDGSGKYHVDSVKGRFTISRDNAKNSLYLQMNSLRAEDTAVYYCTRDEGGWYDYWGQGTLVTVSS

SEQ ID NO: 1288 - protein, 111 aa, Homo sapiens
QSALTQPASVSGSPGQSITISCTGTSSDVGSYNPVSWYQQHPGKAPKVMIYEGSKRPSGVSNRFSGSKSGNTASLTISGLQAEDEADYYCCSYARSSTFVVFGGGTKLTVL

SEQ ID NO: 1289 - protein, 120 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAQGGNYYYFDYWGQGTLVTVSS

SEQ ID NO: 1290 - protein, 106 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNSFTFGPGTKVDIK

SEQ ID NO: 1291 - protein, 138 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDAFRVQYYDFWSGYYTGIGYDYYYYGMDVWGQGTTVTVSS

SEQ ID NO: 1292 - protein, 107 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTPYVFGTGTKVTVL

SEQ ID NO: 1293 - protein, 122 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARTDRYYGSGAHFDYWGQGTLVTVSS

SEQ ID NO: 1294 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPGTFGQGTKVEIK

SEQ ID NO: 1295 - protein, 130 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTTRLDYDYIWGSYRLYGMDVWGQGTTVTVSS

SEQ ID NO: 1296 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLWTFGQGTKVEIK

SEQ ID NO: 1297 - protein, 121 aa, Homo sapiens; identical to SEQ ID NO: 1193

SEQ ID NO: 1298 - protein, 106 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPTFGPGTKVDIK

SEQ ID NO: 1299 - protein, 122 aa, Homo sapiens
QLPLQESGPGLVKPSETLSLTCTVSGGSISSSSYYWGWIRQPPGKGLEWIGSIYYSGSTFYNPSLKSRVTISGDTSKNQFSLKVTSVTAADTAVYYCARGSGSSGWYAFDIWGQGTMVTVSS

SEQ ID NO: 1300 - protein, 110 aa, Homo sapiens
QSALTQPASVSGSPGQSITISCTGTSSDFGGYNYVSWYQQHPDKAPKLMIYDVSNRPSGVSNRFSGSKSGNTASLTISGLQAEDEADYYCSSYTTSSTWVFGGGTKLTVL

SEQ ID NO: 1301 - protein, 131 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDLYYYDSSGYYFNPRPMWYFDLWGRGTLVTVSS

SEQ ID NO: 1302 - protein, 106 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWPFFGQGTRLEIK

SEQ ID NO: 1303 - protein, 121 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATASVLRNYNWFDPWGQGTLVTVSS

SEQ ID NO: 1304 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVFGTGTKVTVL

SEQ ID NO: 1305 - protein, 124 aa, Homo sapiens
EVQLVESGGDLIQPGGSLRLSCAASGFTVRDNYMSWVRQAPGKGLEWVSIIFKSGTKYYADSVKGRFTISRDNSKNTLYLQMNSLRAEDSAVYYCSRGSPPSSGTLYYKPFDQWGQGTLVIVSS

SEQ ID NO: 1306 - protein, 107 aa, Homo sapiens
DIQMTQSPSTLSASLGDRVTITCRASQNISSWLTWYQQKPGKAPKLLIYKASSLESGVPPRFSGSGSGTEFTLTISGLQTDDFATYYCLQYATYWYTFGQGTKLEIK

SEQ ID NO: 1307 - protein, 118 aa, Homo sapiens
QITLKESGPTLVKPTETLTLTCTFSGFSLTRTGEAAGWIRQAPGRALEWVTVIFWDDDKRYSPSLKNRVSVTKDTSKSRVVLRMTHVDPVDTATYFCWAMGGPGNEYFGQGTLVAVSS

SEQ ID NO: 1308 - protein, 112 aa, Homo sapiens
QSVLTQPPSVSGAPGQRVTVSCTGTSSSIGPYSDVHWYQHISGKAPRLLIFGTSNRPSGVPDRFSGSKSGTSASLVIAGLQAEDEADYYCQSYDSSLGEIYVFGTGTTVTVL

SEQ ID NO: 1309 - protein, 121 aa, Homo sapiens
QVQLVESGGGVVQPGRSLRLSCAASGFTFSSYAMHWVRQAPGKGLEWVAVISYDGNNKYYADSVKGRFTVSRDNSKNTLYLQMNSLRAEDTAVYYCARPRGGTYNNWFDPWGQGTLVTVSS

SEQ ID NO: 1310 - protein, 108 aa, Homo sapiens; identical to SEQ ID NO: 830

SEQ ID NO: 1311 - protein, 125 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDDAWGFLEWLDSSMDVWGQGTTVTVSS

SEQ ID NO: 1312 - protein, 111 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTRTFGQGTKVEIK

SEQ ID NO: 1313 - protein, 121 aa, Homo sapiens
QVQLVESGGGVVQPGRSLRLSCAASGFTFATYAMHWVRQAPGKGLEWVALISHDGSNKHYADSVKGRFTISRDNSKKTLYLQMNSLRAEGTAIYYCARESLEAAAPPFDYWGQGTLVTVSS

SEQ ID NO: 1314 - protein, 107 aa, Homo sapiens; identical to SEQ ID NO: 1062

SEQ ID NO: 1315 - protein, 122 aa, Homo sapiens
QVQLVQSGSELKKPGASVKLSCQASGYTFTNHAMNWVRQAPGQGLEWMGWINTNTGNPTYAQGFTGRFVFSLDASVSTAYLHISILEPEDTAFYFCARASARPGVATNLDFWGQGTLVVVSS

SEQ ID NO: 1316 - protein, 107 aa, Homo sapiens
DIQMTQSPSSLSASVGDRVTITCRASQNIDNYLNWYQQKPGEAPNLLIYAASRLHSGVPSRFSGSGSGTEFTLIISSLQPEDLATYYCQQSYSNPLTFAPGTKVDIR

SEQ ID NO: 1317 - protein, 126 aa, Homo sapiens; identical to SEQ ID NO: 1167

SEQ ID NO: 1318 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPVTFGQGTKLEIK

SEQ ID NO: 1319 - protein, 122 aa, Homo sapiens
QITLKESGPTLVKPTETLTLTCDFSGFSLNNSDVGVAWIRQPPGKALEWLALIFWDDDKRYNPSLKSRLTVTKDTSKNQVVLTMTNMDPVDTATYYCARRRVTTRYFWFDPWGQGTLVTVSA

SEQ ID NO: 1320 - protein, 108 aa, Homo sapiens
EIVLTQSPGTLSLSPGQRATLSCRASQSVSSSYLAWYQQKPGQAPRLLIYGTSNRATGIPDRFSGSGSGTDFTLTISRLEPEDFAMYYCLQYGWSLYTFGQGTKLEIK

SEQ ID NO: 1321 - DNA, 369 bp, Homo sapiens
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatctccctgaagactacggtgactacggctactttgactactggggccagggaaccctggtcaccgtctcctca

SEQ ID NO: 1322 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggtcctgtggtattcggcggagggaccaagctgaccgtccta

SEQ ID NO: 1323 - DNA, 402 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaccaggactattacgatttttggagtggttatttccccgggcgtggcccatactactactacggtatggacgtctggggccaagggaccacggtcaccgtctcctca

SEQ ID NO: 1324 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctatcaccttcggccaagggacacgactggagattaaa

SEQ ID NO: 1325 - DNA, 366 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagacggggtggctggtactcggaatacttccagcactggggccagggcaccctggtcaccgtctcctca

SEQ ID NO: 1326 - DNA, 333 bp, Homo sapiens
cagtctgccctgactcagcctgcctccgtgtctgggtctcctggacagtcgatcaccatctcctgcactggaaccagcagtgacgttggtcgttataactttgtctcctggtaccaacaacacccaggcacagcccccaaactcatgatttatgatgtcactaatcggccctcaggaatttctgatcgcttctctggctccaagtctggcaacacggcctccctgagcatctctgggcttcaggctgaggacgaggctgattattactgcagctcatatacaagcaccaccactctcgaagtcttcggaactgggaccaaggtcaccgtccta

SEQ ID NO: 1327 - DNA, 375 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggagttgttgatcctgaagatggtgaaacaatatacgcagagaagttccagggcagagtcaccataaccgcggacacgtctacagacacagcctacatggagctgagcagcctgagatctgaggacacggccgtgtattactgtgcaatacccagatattttgactggttattgtctcggcactacggtatggacgtctggggccaagggaccacggtcaccgtctcctca

SEQ ID NO: 1328 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccgtcactttcggccctgggaccaaagtggatatcaaa

SEQ ID NO: 1329 - DNA, 384 bp, Homo sapiens
caggtgcagctggtgcagtctggggctgaggtgaagaggcctggggcctcagtgaaggtctcctgcaaggcttctggatacaccttcaccagttatgatatcaactgggtgcgacaggccactggacaagggcttgagtggatgggatggatgaacccttacagtggtaacacaggctatgcacagaagtttcagggcagagtcaccatgaccaggaacacctccataagcacagcctacatggagctgagcagcctgagatctgaggacacggccgtgtattcctgtgcgacggcttttaccgaacaggatattgtagtggtggtaggacataacggggcttttgatatctggggccaagggacaatggtcaccgtctcttca

SEQ ID NO: 1330 - DNA, 342 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacattgaaaatcagcagagtggaggctgaggatgttggggcttattactgcatgcaagctctacaaactcctccgatgctcactttcggcggagggaccaaggtggagatcaaa

SEQ ID NO: 1331 - DNA, 366 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagagcgttcccttgacagtggcctagggtcctttgactactggggccagggaaccctggtcaccgtctcctca

SEQ ID NO: 1332 - DNA, 330 bp, Homo sapiens; identical to SEQ ID NO: 266

SEQ ID NO: 1333 - DNA, 351 bp, Homo sapiens
gaggtgcagctggtggagtctgggggaggcttggtccagcctggggggtccctgagactctcctgtgcagcctctggagtcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagattccggggatgatgcttttgatatctggggccaagggacaatggtcaccgtctcttca

SEQ ID NO: 1334 - DNA, 327 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctccgaaggtcactttcggccctgggaccaaagtggatatcaaa

SEQ ID NO: 1335 - DNA, 366 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtatattactgtgcaacaggccccccctttggtagcaggtacaactggttcgacccctggggccagggaaccctggtcaccgtctcctca

SEQ ID NO: 1336 - DNA, 333 bp, Homo sapiens; identical to SEQ ID NO: 284

SEQ ID NO: 1337 - DNA, 360 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaaccttatatagtggctacgatttgccctttgactactggggccagggaaccctggtcaccgtctcctca

SEQ ID NO: 1338 - DNA, 321 bp, Homo sapiens
gccatccagttgacccagtctccatcctccctgtctgcatctgtaggagacagagtcaccatcacttgccgggcaagtcagggcattagcagtgctttagcctggtatcagcagaaaccagggaaagctcctaagctcctgatctatgatgcctccagtttggaaagtggggtcccatcaaggttcagcggcagtggatctgggacagatttcactctcaccatcagcagcctgcagcctgaagattttgcaacttattactgtcaacagtttaatacttacctgtacacttttggccaggggaccaagctggagatcaaa

SEQ ID NO: 1339 - DNA, 354 bp, Homo sapiens
caggtgcatctacagcagtggggcgcaggactgttgaagccttcggagaccctgtcccgcacctgcgctgtgtatggtggatccttcagtggttaccattggagctggatccgccagcccccagggaaggggctggagtggattggggagatcaatcatagtggaagccccaactacaacccgtccctcaagagtcgagtcaccctatcagtggacacgtccaagaaccagttctccctgaaactgaactctgtgaccgccgcggacacggctgtatattactgtacgagactttatgcaggtatggactacttcgactactggagccagggaaccctggtcaccgtctcctca

SEQ ID NO: 1340 - DNA, 321 bp, Homo sapiens
gacatccagatgacccagtctccatcctccctgtctgcatctgttggagacagagtcaccgtcacttgccgggcaagtcagaccatcaacagctatttaaactggtatcaccagaagccagggaaagcccctaatctcctgatctatgctgcatccaatttgcaaagtcgggtcccatcaaggttcagtggcaatggatctgggacagatttcactctcaccgtcaccagtctgcaacctgaggattttggaacttactactgtcaacagagttacagtaccccgtacacttttggccaggggaccaagctggagatcaga

SEQ ID NO: 1341 - DNA, 396 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcggaccgaagacggtattacgatttttggagtggtttactactactacggtatggacgtctggggccaagggaccacggtcaccgtctcctca

SEQ ID NO: 1342 - DNA, 324 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccggacacttttggccaggggaccaagctggagatcaaa

SEQ ID NO: 1343 - DNA, 366 bp, Homo sapiens
gaagtgcagctggtggagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagattcagagcagtggtcctactactacggtatggacgtctggggccaagggaccacggtcaccgtctcctca

SEQ ID NO: 1344 - DNA, 321 bp, Homo sapiens
gaaattgtgttgacacagtctccagccaccctgtctttgtctccaggggaaagagccaccctctcctgcagggcccgtcagagtgttagcaactacttagcctggtaccaacagaaacctggccaggctcccaggctcctcatctatgatgcatccaacagggcccctggcatcccagccaggttcagtggcagtgggtctgggacagacttcactctcaccatcagcagcctagagcctgaagattttgcagtttattactgtcagcagcgtagcaactggccgctcactttcggcggagggaccaaggtggagatcaaa

SEQ ID NO: 1345 - DNA, 369 bp, Homo sapiens
gaggtgcagctggtggagtccgggggaggcttagttcagccgggggggtccctgagactctcctgtgcagcctctggattcagcttcagtgactactggatgcactgggtccgccaagctccagggaaggggctggtgtgggtctcgcgtattaataatgatgggacaagtataacctacgcggactccgtgaagggccgatacaacatctccagagacaacgccaagaacacggtgtatttgcaaatgaacagtctgagagtcgaagacacggctctctattattgtgtaagagggaggaagtgggaagtactacgagggagtgattttgatatctggggccaagggacaacggtcaccgtctcttca

SEQ ID NO: 1346 - DNA, 324 bp, Homo sapiens
gaaattgtgttgacgcagtctgcaggcaccctgtctttgtctccaggagacagagccgccctctcctgcagggccagtcagagtattagcagcttctacttagcctggttccagcaaaaacctggccaggctcccaggctcctcatctatggtgcatccaacagggccactggcatcccagacaggttcagtggcagtgggtctgggacagacttcactctcaccatcagcagtctggagcctgaagattttgcagtgtattactgtcagcactatggtatttcaccgtacacgtttggccaggggaccaagctggagatcaaa

SEQ ID NO: 1347 - DNA, 360 bp, Homo sapiens
caggtgcagctgcaggagtcgggcccaggactggtgaagccttcggggaccctgtccctcacctgcgctgtctctggtggctccatcagcagtagtaactggtggagttgggtccgccagttcccagggaaggggctggagtggattggggaaatctatcatagtggaagaaccaactacaacccgtccctcaagagtcgagtcaccatatcagtagacaagtccaagaaccagttctccctgaagctgagctctgtgaccgccgcggacacggccgtgtattactgtgcgcgagtgggcgatattttgactggtttacttgactactggggccagggaaccctggtcaccgtctcctca

SEQ ID NO: 1348 - DNA, 327 bp, Homo sapiens
tcctatgtgctgactcagccaccctcagtgtcagtggccccaggaaagacggccaggattacctgtgggggaaacaacattggaagtaaaaatgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcatttttatgtcttcggaactgggaccaaggtcaccgtccta

SEQ ID NO: 1349 - DNA, 363 bp, Homo sapiens
caggtgcagctgcaggagtcgggcccaggactggtgaagccttcacagaccctgtccctcacctgcactgtctctggtggctccatcagcagtggtgattactactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagagaggaacgatttttggagtggtttctttccccctggggccagggaaccctggtcaccgtctcctca

SEQ ID NO: 1350 - DNA, 330 bp, Homo sapiens; identical to SEQ ID NO: 146

SEQ ID NO: 1351 - DNA, 351 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcacttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagatactgggggcggtatggacgtctggggccaagggaccacggtcaccgtctcctca

SEQ ID NO: 1352 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgccaggcgtgggacagcagcattgtggtattcggcggagggaccaagctgaccgtccta

SEQ ID NO: 1353 - DNA, 366 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatcgccccggtgactacgtttggggatacttcgatctctggggccgtggcaccctggtcactgtctcctca

SEQ ID NO: 1354 - DNA, 327 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttattctgtggtattcggcggagggaccaagctgaccgtccta

SEQ ID NO: 1355 - DNA, 387 bp, Homo sapiens
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcagctattggttctgctggtgacacatactatccaggctccgtgaagggccgattcaccatctccagagaaaatgccaagaactccttgtatcttcaaatgaacagcctgagagccggggacacggctgtgtattactgtgcaagaggggatatagtggctacgatccccggggatctgcgttactactactactacggtatggacgtctggggccaagggaccacggtcaccgtctcctca

SEQ ID NO: 1356 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtacacttttggccaggggaccaagctggagatcaaa

SEQ ID NO: 1357 - DNA, 381 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagatcgcctttatgattacatttgggggagttatcgcatttttgactactggggccagggaaccctggtcaccgtctcctca

SEQ ID NO: 1358 - DNA, 324 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcccttcactttcggccctgggaccaaagtggatatcaaa

SEQ ID NO: 1359 - DNA, 381 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagtcgaagtgactacgggtgtagacgattactactactactacggtatggacgtctggggccaagggaccacggtcaccgtctcctca

SEQ ID NO: 1360 - DNA, 324 bp, Homo sapiens; identical to SEQ ID NO: 98

SEQ ID NO: 1361 - DNA, 378 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagaggggtctaatatggttcggggagtcattaactggtacttcgatctctggggccgtggcaccctggtcactgtctcctca

SEQ ID NO: 1362 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtgctcctcggacgttcggccaagggaccaaggtggaaatcaaa

SEQ ID NO: 1363 - DNA, 354 bp, Homo sapiens
cagatcaccttgaaggagtctggtccaacgctggtgaaacccacagagaccctcacgctgacctgcaccttctctggcttctctgtcactagaactggggaggctgcgggctggatccgtcaggccccaggaagggccctggagtgggtaacagtcattttttgggatgatgataagcggtacagtccatctcttaagaacagactcaccgtcaccaaggacagttccaaacatcaagtggtccttacaatgaccaacgtggaccctgtggatgcagccacatatttctgttgggtcatggggggacctggaaaggaatactttggccagggatccctggtcgccgtctcctca

SEQ ID NO: 1364 - DNA, 336 bp, Homo sapiens
cagtctgtactgacccagccgccctcagtgtctggggccccggggcagagggtcaccgtctcctgcactgggaccagttccagcatcgggccttattctgatgtgcactggtatcagcacgtttcaggaaaagcccccaggctcctcatctttggaaccagcaatcggccctcgggggtccctgaccgattctctggctccaagtccggcacctcagcctccctagtcatcgctgggctccgggctgaggatgaggctgattattactgccagtcttatgacagcagtctgggtgagatttatgtcttcggaactgggaccacggtcaccgtccta

SEQ ID NO: 1365 - DNA, 366 bp, Homo sapiens; identical to SEQ ID NO: 385

SEQ ID NO: 1366 - DNA, 324 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgcccggccctcagggatccctgagcgattctctggctccaactctgggaacacggccaccctgaccatcagcagggtcgaagccggggatgaggccgactattactgtcaggtgtgggatagtagtagtgatcctgtggtattcggcggagggaccaagctgaccgtccta

SEQ ID NO: 1367 - DNA, 363 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgggagtggctggactctactactactacggtatggacgtctggggccaagggaccacggtcaccgtctcctca

SEQ ID NO: 1368 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 1369 - DNA, 375 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgggggaagtggttactacactaaactactactactacggtatggacgtctggggccaagggaccacggtcaccgtctcctca

SEQ ID NO: 1370 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcacgtgggtgttcggcggagggaccaagctgaccgtccta

SEQ ID NO: 1371 - DNA, 375 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagctcacacggtgactacgttgttgggtcctactactacggtatggacgtctggggccaagggaccacggtcaccgtctcctca

SEQ ID NO: 1372 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccccccgacgttcggccaagggaccaaggtggaaatcaaa

SEQ ID NO: 1373 - DNA, 378 bp, Homo sapiens
gaggtgcagctggtggagtctggaggacacttgatccagcctggggggtccctgagactctcctgtgcagcctctgggttcaccgtcagtagcaactacatgaactgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagtcgggcatattgtggtggggaggtttggggttgctactactacggtatggacgtctggggccaagggaccacggtcaccgtctcctca

SEQ ID NO: 1374 - DNA, 318 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccctcactttcggcggagggaccaaggtggagatcaaa

SEQ ID NO: 1375 - DNA, 375 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagatcttacataatacggtcctacgatttttggagtggcccgcggcttgatatctggggccaagggacaatggtcaccgtctcttca

SEQ ID NO: 1376 - DNA, 321 bp, Homo sapiens
gacatccagatgacccagtctccatcctccctgtctgcatctgtaggagacagagtcaccatcacttgccaggcgagtcacgacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcctcctcaccttcggccaagggacacgactggagattaaa

SEQ ID NO: 1377 - DNA, 360 bp, Homo sapiens
caggtgcagctggtggagtctgggggaggcgtggtccagcctgggaggtccctgagactctcctgtgcagcctctggattcaccttcagaagttatgttatgtactgggtccgccaggctccaggcaaggggctggagtgggtggcaattatctcatatgatggaagcaataaatactacgcagactccgtgaagggccgattcaccatttccagagacaattccaaggacacgctgtatctgcaaatgagcagcctgatagctgaggacacggctgtgtattactgtgcgagagctacgaccgtggtgctggggtacttcgatctctggggccgtggcaccctggtcactgtctcctct

SEQ ID NO: 1378 - DNA, 330 bp, Homo sapiens
cagtctgtgctgacgcagccgccctcagtgtctggggccccagggcagagggttaccatctcctgcactgggagcagttccaacatcggggcaggttatgacgtacactggtaccagcagcttccaggaacagcccccaaactcctcatctatggtaacaataatcggccctcaggggtccctgaccgattctctggctccaagtctggcacttcagcctccctggccatcattgggctccaggctgaggatgaggctgattattactgccagtcctatgacagtagcctgagtgtggtattcggcggagggaccaagttgaccgtccta

SEQ ID NO: 1379 - DNA, 393 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagctctttccgtggttcagggagttaccaccgccagggattactactactactacggtatggacgtctggggccaagggaccacggtcaccgtctcctca

SEQ ID NO: 1380 - DNA, 336 bp, Homo sapiens; identical to SEQ ID NO: 120

SEQ ID NO: 1381 - DNA, 363 bp, Homo sapiens
gaggtgtcgttattgcagtctgggggaggcttggtacagcctggggggtccctcagactctcctgtgcagccgctggattcacctttaacactaacattggcatgacctgggtccgccaggctccagggaaggggccggagtgggtctcaactattagtggtgtctatacatattacgcagacttcgtgaagggccggttcaccatctccagagacagttccacgaacactctctatctgcaaatgaacagcctgagaggcgaggacacggccgtctattactgtgcgacatttgctcggcctagcctgagtcgtaggtggttcgacccctggggcccgggaaccctggtcatcgtctcctca

SEQ ID NO: 1382 - DNA, 321 bp, Homo sapiens
gacatccagatgacccagtctccatcttccgtgtctgcatctgtaggagacagagtcaccatcacttgtcgggcgagtcaggatattgccacctggttagcctggtatcagcaaaaaccagggaaagcccctaaactcctgatctatgctgcgtccagtttgcacagtggggtcccatcaagattcagcggcagtggatctgggacagatttcactctcaccatcaacagcctgcagcctgaagactttgcaacttactattgtcaacaggctaatggtttcccgctaattttcggcggagggaccaaggtcgagatcaaa

SEQ ID NO: 1383 - DNA, 369 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtctttattatagtgggagcacctactacaacccgtccctcaagagtcgagtcaccatatccgcagacacgtccaagaaccagttctccctgaacctgagctctgtgaccgccgcagacacggctctgtattactgtgcgagacatggtattagtagctggttccggactccctttgactactggggccagggaaccctggtcaccgtctcctcc

SEQ ID NO: 1384 - DNA, 324 bp, Homo sapiens
gaaattgtgttgacgcagtctccaggcaccctgtctttgtctccaggggaaagagccaccctctcctgcagggccagtcagagtgttagcagcagcttcttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatgagagttcacctcgaacgttcggccaagggaccaaggtggaaatcaaa

SEQ ID NO: 1385 - DNA, 387 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagacgggccgatattttgactggttattatggtgactcctactactacggtatggacgtctggggccaagggaccacggtcaccgtctcctca

SEQ ID NO: 1386 - DNA, 321 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctatcaccttcggccaagggacacgactggagattaaa

SEQ ID NO: 1387 - DNA, 384 bp, Homo sapiens
caggtgcagctggtggagtctgggggaggcgtggtccagcctgggaggtccctgagactctcctgtgcagcctctggattcaccttcactagttatcatatgcactgggtccgccaggctccaggcaaggggctggagtgggtggcagctatatcatctgatggcagtaaaaaatactacgcagcctccgtgaagggccgactcaccatctccagagacaattccaagaacacgctgtatgtggagatgaacaggctaacagctgacgacacggctctatatttctgtgcgagatttcgaccgagccctaaactgtatagcactggatgggacaactactactttgactattggggccagggaatcctggtcaccgtctcctca

SEQ ID NO: 1388 - DNA, 330 bp, Homo sapiens
cagtctgtgctgactcagccaccctcagcgtctgggacccccgggcagagggtcgccatctcttgctctggaagcagctccaacatcggaagtactgctgtcaactggtaccaacagctcccaggaacggcccccatactcctcatctatagtgataatcagcgaccctcaggtgtccctgaccgattctctggttccaagtctggcacctcagcctccctggccatcagtgggctccagtctgaggatgaggctgattattactgtgcagcatgggatgtcagcctgaatggtgtgctgttcggcggagggaccaaggtgaccgtccta

SEQ ID NO: 1389 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcacttatatcaaatgatggaagtaataaatactacgcagactccgtgaagggccgattcaccatctccagagacaattccaagaacacgctgtatctgcaaatgaacagcctgagagctgagggcacggccatatattactgtgcgagagagggtttagaagcagctgcccccccctttgactactggggccagggaaccctggtcaccgtctcctca

SEQ ID NO: 1390 - DNA, 321 bp, Homo sapiens
tcctatgagttgactcagccaccctcagtgtccgtgtccccaggacagacagccaccatcacctgctctggagataaattgggggagaaatatgcttcctggtatcagcagaagccaggccagtcccctgtagtggtcatctatcaagataggaagcggccctcagggatccctgagcgattctctggctccaactctgggaacacagccactctgaccatcagcgggacccaggctatggatgaggctgactattactgtcaggcgtgggacagcagcaattctgtggtgttcggcggagggaccaagctgaccgtccca

SEQ ID NO: 1391 - DNA, 384 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatttgagggaatatgattacatttgggggagttatcgtcccctcggtatggacgtctggggccaagggaccacggtcaccgtctcctca

SEQ ID NO: 1392 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattacacttttggccaggggaccaagctggagatcaaa

SEQ ID NO: 1393 - DNA, 357 bp, Homo sapiens
caggtgcaattggtggactctgggggaggcgtggtccagcctgggaggtccctgagactctcctctgcagcctctggattcgccttcagtacctatcctatgcactgggtccgccaggctccaggcaaggggctggagtgggtggcagttatatcatatgatggaagtaatgtatactacgcagactccgtgaagggccgattcaccatctccagagacaattccaagaacacgctgtttctgcaaatgagcaccctgagagctgaggacacggctgtgtattactgtgcgagagattcgggggataatagtggtcctgactactggggccagggaaccctggtcaccgtctcctca

SEQ ID NO: 1394 - DNA, 324 bp, Homo sapiens
tcgtctgagctgactcaggaccctgctgtgtctgtggccttgggacagacagtcaggatcacatgccaaggagacagcctcagaagctattttccaagctggtaccagcagaagccaggacaggcccctgtacgtgtcatctatggtaaaaacaaccggccctcagggatcccagaccgattctctggctccagctcaggaaacacagcttccttgaccatcactggggctcaggcggaagatgaggctgactattactgtctctcctgggacagcagtggtacccatgtggtcttcggcggagggaccaagctgactgtccta

SEQ ID NO: 1395 - DNA, 375 bp, Homo sapiens
gaagtgcagctggtggagtctgggggaggcttgctacagcctggcaggtccctgagactctcctgtgcagcctctggattcacctttgatgattatgccatgcactgggtccggcaagttccagggaagggcccggagtgggtctcagggatcacttggaatggtggtaccataggctatgcggactctgtgaagggccgattcagcatctccagagacaacgccaagaaatccctgtatttgcaaatgaacagtctgagagctgaggacacggccctgtattactgtgcaaaagatatgggaccgagggatttttggagcgaattggggggtatggacgtctggggccaagggaccacggtcaccgtctcttca

SEQ ID NO: 1396 - DNA, 324 bp, Homo sapiens
gaaattgtgttgacgcagtctccaggcaccctgtctttgtctccagggaaaagagccaccctctcctgcagggccagtcagagtgttagcagcaactacttagcctggtaccagcagaaacctggccaggctcccaggctcctcatctatggtgcatccagcagggccactggcatcccagacaggttcagtggcagtgggtctgggacagacttcactctcaccatcaacagactggagcctgaagattttgcagtgtattactgtcagcagtatggtaggtcaccggacacttttggccaggggaccaagctggagatcaaa

SEQ ID NO: 1397 - DNA, 363 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagggtggggttcagggacttattatgcttttgatatctggggccaagggacaatggtcaccgtctcttca

SEQ ID NO: 1398 - DNA, 330 bp, Homo sapiens; identical to SEQ ID NO: 270

SEQ ID NO: 1399 - DNA, 360 bp, Homo sapiens
caggtacagctgcaggagtcgggcccaagactggtgaagccttcacagaccctgtccctcacctgcactgtctctggtggctccatcatcagtggtgcttactactggacctggatccgccagcacccagagaagggccttgagtggattggctacatctattacagtgggagcacctcctacagcccgtccctcaagagtcgacttaccatatcactagacaggtctcagaaccagttctccctgaagctgacctcagtgactgccgcggacacggccgtctattactgtgcgagaggggttgcagcagctggtgcgagtgacttctggggccagggaaccctggtcaccgtctcctca

SEQ ID NO: 1400 - DNA, 327 bp, Homo sapiens
gaaatagtgatgacgcagtctccaggcaccctgtctgtgtctccaggggaaagagtcaccctctcctgcagggccagtcagagtgttagtagtaacttagcctggtaccagcagaaacctggccaggctcccaggctcctcatctttggtacatccaccagggccactggtatcccagccaggttcagtggtagtgggtctgggacagagttcactctcaccatcagcagcctgcagtctgaagattttgcagtttattactgtcagctgtatactaataggcctcccatgtacacttttggccaggggaccaagctggagatcaag

SEQ ID NO: 1401 - DNA, 378 bp, Homo sapiens
gaagtgcagctggtggagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagccactcggggtttcggtgggaactactaacgtacggtatggacgtctggggccaagggaccacggtcaccgtctcctca

SEQ ID NO: 1402 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 1403 - DNA, 384 bp, Homo sapiens; identical to SEQ ID NO: 443

SEQ ID NO: 1404 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcctattcactttcggccctgggaccaaagtggatatcaaa

SEQ ID NO: 1405 - DNA, 387 bp, Homo sapiens
cagatcaccttgaaggagtctggtccttcgctggtgaaacccacacagaccctcacgctgacctgcaccttctcggggttctcactcagcactagaggagtgggtgtggactggatccgtcagcccccaggaaaggccccggagtggcttgcactcatttattgggatgatgataagcgatacaacccatctctgaagaccaggctcaacatcaagaggggcacctccagaaatcaggtggtcctgacaatgaccaagatggaccctggggacacagccacttattactgtgcacaccgacattgtaagagtaacacttgttatgcggccgccccatatgatggtttagatttgtggggccaagggacaatggtcaccgtctcttca

SEQ ID NO: 1406 - DNA, 324 bp, Homo sapiens
tcctacgtgctgactcagccaccctcagtgtcagtggccccaggaaagacggccaggattacctgtgcgggaaacaacattgcaactcagagtgtgcactggtaccagcacaagccaggccaggcccctgtgctggtcatctcttacggtagcgaccggccctcagggatccctgagcggttctctggctccaagtctgggaacacggccaccgtgaccatcactagggtcgaagccggggatgaggccgactattactgtcaggtgtgggacagaagtagtggtcaagttgtcttcggaagtgggaccaaggtcaccgtcctg

SEQ ID NO: 1407 - DNA, 375 bp, Homo sapiens; identical to SEQ ID NO: 407

SEQ ID NO: 1408 - DNA, 330 bp, Homo sapiens
cagtctgccctgactcagcctccctccgcgtccgggtctcctggacagtcagtcaccgtctcctgcactggaaccggcagtgacgttggtggttataactatgtctcctggtaccaacagcacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatgcaggcagcaacattgtggtcttcggcggagggaccaagctgaccgtccta

SEQ ID NO: 1409 - DNA, 363 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcgcctactacaacccgtccctcaagagtcgagttatcatatcagtcgacacgtctaagaaccagttctccctgaggctgagctctgtgactgccgcggacacggccgtgtattactgtgcgaggtgtatagcagcagcaaactggtacttcgatctctggggccgtggcaccctggtcactgtctcctca

SEQ ID NO: 1410 - DNA, 330 bp, Homo sapiens
cagtctgccctgactcagcctcgctcagtgtccgggtctcctggacagtcagtcaccatctcctgcactggaaccagcagttatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctactcttgggtgttcggcggagggaccaagctgaccgtccta

SEQ ID NO: 1411 - DNA, 366 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagtaggggaatatagtggctacgatttgttctttgactactggggccagggaaccctggtcaccgtctcctca

SEQ ID NO: 1412 - DNA, 333 bp, Homo sapiens
aattttatgctgactcagccccactctgtgtcgaagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaaggggtgttcggcggagggaccaagctgaccgtccta

SEQ ID NO: 1413 - DNA, 378 bp, Homo sapiens; identical to SEQ ID NO: 55

SEQ ID NO: 1414 - DNA, 321 bp, Homo sapiens
gacatccagatgacccagtctccatcctcgctgtctgcatctgtaggggacagaatcaccatcacttgtcgggcgagtcagggcattgggaagtctttagcctggcatcagcagaaaccggggagagcccctaggtccctgatctatggtgcatccaatttgcaaagtggggtcccatcaaagttcagtggcagtggatctgggacagatttcactctcaccatcagcagcctgcagcctgaagattttgcaacttattactgccaacagtatgccagttacccctataccttcgggcctgggaccaaagtggatgtgaaa

SEQ ID NO: 1415 - DNA, 390 bp, Homo sapiens; identical to SEQ ID NO: 477

SEQ ID NO: 1416 - DNA, 333 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaagtacacttttggccaggggaccaagctggagatcaaa

SEQ ID NO: 1417 - DNA, 393 bp, Homo sapiens
caggtgcagctgcaggagtcgggcccaggactgctgaagccttcggagacgctgtccctcacctgcactgtctctggtgtctccgtcagcagaagtaattactactggggctggatccgccagcccccagggaagggactggagtggattggaagtatctattatagaggcagcacccactacaacccgtccctcaggagtcgagtcaccatatccatagacacgtccaagaaccagttctccctgaggctgagctctgtgatcgccgcagacacggctgtctattactgtgcgagagtgaccacccgacagcgaatctcgtactcccatgatagtggtgacttcaactggttcgacccctggggccagggaaccctggtcaccgtctcctca

SEQ ID NO: 1418 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctttgctaacaccaatcggccgtcaggggtccctgaccgattctctggctccaagtctggcacctcagcctccctggccatcactgggctccaggctgaagatgaggctgattattactgccagtcctatgacagcagcctgagtggttatgtcttcggaactgggaccaaggtcaccgtccta

SEQ ID NO: 1419 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaccccatagtgggagctacttgagtgatcttgactactggggccagggaaccctggtcaccgtctcctca

SEQ ID NO: 1420 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccagggacgttcggccaagggaccaaggtggaaatcaaa

SEQ ID NO: 1421 - DNA, 363 bp, Homo sapiens
gaggtgcagctgttggagtctgggggaggcttggtacagcctggggggtccctgagactctcctgtgcagcctctggatttacctttagcttctatgccatgagttgggtccgccaggctccagggaaggggctggagtgggtctcacttatttatagcgatgatagtaccacatactattcagactccgtgaagggccggctcgccatcttcagagataattccaagaacacgctgtacctgcaaatgaacagcctgagagccgaggacacggccatatattactgtgcgaaaactcctggggggattacggtgactcattttgactactggggtcagggaacgctggtcaccgtctcctca

SEQ ID NO: 1422 - DNA, 330 bp, Homo sapiens
caatctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatgatttatgacgtcattaagcggccctcaggggtttctagtcgcttctctggctccaagtctgccaacacggcctccctgacagtctctgggctccaggctgaggacgaggctgattattactgctgctcatatgcagctaccctaggggtggtattcggcggagggaccaaactgaccgtccta

SEQ ID NO: 1423 - DNA, 363 bp, Homo sapiens
gaggtgctggtggagtctgggggaggcttggtccagcctggggggtccctgagactcgcctgtgcagcgtctggattcacgtttaggagttattggatgaactgggtccgccaggctccagggaaggggctggagtgggtggcctacatcaaagaggatggaagtgagaaatactatctggactctgtgaagggccgattcaccatctccagagacaacgtcaggaattcactgtatttgcaattgagcagcctgcgacccgaagacacggctgtttatttttgttcgagactccggtcggggcgaaactggggtgatggttatgatatttggggccaagggacaatggtcaccgtctcttca

SEQ ID NO: 1424 - DNA, 321 bp, Homo sapiens
gacatccagatgacccagtctccatcctccctgtctgcttctgtaggaggcagagtcaccgtcacttgccgggcaagtcagaacattaacacttatttcaattggtatcagcagaagccagggaaagcccctcagctcctgatctatgctgcatccactttacaaagtggtgtcccatcaaggttcagtggcagtggatctgggacatatttcactctcaccatcagcagtctgcaacctgaagattttgcaacttactactgtcaacagactcaaagtatccctcacacttttggccaggggaccagggtggagatcaaa

SEQ ID NO: 1425 - DNA, 360 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgacccagcagtggcttcgaggcaggttcgacccctggggccagggaaccctggtcaccgtctcctca

SEQ ID NO: 1426 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcatcattgggtgttcggcggagggaccaagctgaccgtccta

SEQ ID NO: 1427 - DNA, 384 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatatgacgtattacgatttttggagtggttattataccggtagggggttggactactggggccagggaaccctggtcaccgtctcctca

SEQ ID NO: 1428 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatcctctcactttcggcggagggaccaaggtggagatcaaa

SEQ ID NO: 1429 - DNA, 366 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagcccttgcagcagctggttactggtacttcgatctctggggccgtggcaccctggtcactgtctcctca

SEQ ID NO: 1430 - DNA, 330 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgtaggcagctacacttgggtgttcggcggagggaccaagctgaccgtccta

SEQ ID NO: 1431 - DNA, 360 bp, Homo sapiens
gaggtgcagctggtggagtctgggggaggcctggtcaagcctggggggtccctgagactctcctgtgcagcctctggattcaccttcagtagccatagcgtgaactgggtccgccaggctccagggaaggggctggagtgggtctcatccattagtagtagtagtagttacatatcctacgcagactcagtgaagggccgattcaccatctccagagacaacgccaagaactcactgtatctgcaaatgaacagcctgagagccgaggacacggctgtgtattactgtgcgagagattcgggcataatagcagcatcgtttgactactggggccagggaaccctggtcaccgtctcctca

SEQ ID NO: 1432 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccttggacgttcggccaagggaccaaggtggaaatcaaa

SEQ ID NO: 1433 - DNA, 372 bp, Homo sapiens
caggtacagttggtggagtctgggggaggcgtggtccagcctggggggtccctgagactctcctgttctgcctctggattcaccttcaataattacggttttcactgggtccgccaggctccaggcaaggggctggagtgggtggcagttatctcatatgagggaagcaagaaatactacgtggactccgtgcagggccgattcgtgatttccagagacagttccaagaacacactgtttttgcaaatgaacagcctgagacctgaagacacgggtatttattactgtgtgagagcccgggacgttttctggttcagggagtcccgggactttcactactggggccagggaaccctggtcaccgtctcctca

SEQ ID NO: 1434 - DNA, 321 bp, Homo sapiens
gacatccagatgacccagtctccatcctcactgtctgcatctgtaggagacagagtcaccatcacttgtcgggcgagtcaggacattagcagttatttagcctggtttcagcagaagccagggaaagcccctaagtccctgatctatgctgcatccagtctgcagagtggggtcccatcaaagttcagcggcagtggatctgggacagatttcactctcaccatcaccagcctgcagcctgaagattttgcaacttattactgccaacagtataatagttaccctctcactttcggcggagggaccaaggtggagatcaaa

SEQ ID NO: 1435 - DNA, 390 bp, Homo sapiens; identical to SEQ ID NO: 571

SEQ ID NO: 1436 - DNA, 324 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctccgctcactttcggcggagggaccaaggtggagatcaaa

SEQ ID NO: 1437 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgctaatgaacagcctgagagctgaggacacggctgtgtattactgtgcgagaggaatttattcctatgatagtagtggttattactaccttgactactggggccagggaaccctggtcaccgtctcctca

SEQ ID NO: 1438 - DNA, 321 bp, Homo sapiens
gaaattgtgttgacgcagtctccaggcaccctgtctttgtctcccggggaaagagccaccctctcctgcagggccagtcagagtgttagcagcagctacttagcctggtaccagcagaaacctggccgggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacttctttttggccaggggaccaagctggagatcaaa

SEQ ID NO: 1439 - DNA, 369 bp, Homo sapiens; identical to SEQ ID NO: 59

SEQ ID NO: 1440 - DNA, 336 bp, Homo sapiens
cagcttgtgctgactcaatcgccctctgcctctgcctccctgggagcctcggtcaagctcacctgcactctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactggcctcaatgtggtattcggcggagggaccaagctgaccgtccta

SEQ ID NO: 1441 - DNA, 372 bp, Homo sapiens
caggtgcaattggtggagtctgggggaggcgtggtcccgcctggggggtcgctgagcctcccctgtgcagcctctggattcaccttcagtgcctatgctatgcactggctccgccaggctccaggcaaggggctagagtgggtggctgttatctcatatgatggaactgttaaatacgtcgcagactccgtgaggggccgattcaccatctccagagacaattccaacaacactctgtatctgcaaatgaccagcctgagatccgaggacacggctgtctattactgtgcgagagacttaggggcgttagcagcagctccgactgtatacttcgttcactggggccagggcaccctggtcaccgtctcctca

SEQ ID NO: 1442 - DNA, 324 bp, Homo sapiens; identical to SEQ ID NO: 122

SEQ ID NO: 1443 - DNA, 372 bp, Homo sapiens
gaggtgcagttgttggagtctgggggaggcttggtccagccgggggggtccctgagactctcctgtgcagcctctggattcacctttagcagctatgccatgaactgggtccgccaggctccagggaaggggctggagtgggtctcaattatttatagcggttataatggaacatattatacagactccgtgaagggccggttcaccatctccagagataattccaagaacacgctgtatctgcaaatgaacagcctgagagccgaagacacggccgtttattactgtgcgaaaccaaaacccgtaggggatgactacggtgacccttactttgactactggggccagggaaccctggtcaccgtctcctca

SEQ ID NO: 1444 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccggcaatccggggtccctgaccgattcagtggcagcgggtctgggacagatttcactctcaccatcagcagcctgcaggctgaagatgtggcagtttattactgtcagcaatattatattactccgttcacttttggccaggggaccaagctgcagatcaaa

SEQ ID NO: 1445 - DNA, 390 bp, Homo sapiens
ggggtgcagctggtggagtctgggggaggcttggtacagcctggcaggtccctgagactctcctgtgcagcctctggattcacctttcatgattatgccatgcactgggtccggcaagctccagggaagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacttttggaagcagcagctggtacaggggggactcctactactactacggtatggacgtctggggccaagggaccacggtcaccgtctcctca

SEQ ID NO: 1446 - DNA, 339 bp, Homo sapiens; identical to SEQ ID NO: 572

SEQ ID NO: 1447 - DNA, 351 bp, Homo sapiens
caagtgcagttggtggagtctgggggaggcgtggtccagcctggggggtccctcagactctcctgtgaagtgtctggattcaacttcaggacttttgccatgcactgggtccgccaggctccaggcaaggggctggagtgggtggcagtaatatgggatgatggaagtaatcagcattatggagactccgtgaagggccgcttcgccatctccagagacgactccaagaacacggtgtatctgcaaatggacggcctgagagtcgaggacacggctgtctattattgtgcgagagatcgggtcggttattgtgactactggggccagggaacgcacgtcaccgtctcctca

SEQ ID NO: 1448 - DNA, 318 bp, Homo sapiens
gcagtagtgatgacgcagtctccacccaccctgtctctgtctccgggggagcgagccactgtcgcctgcagggccaatcagagtattggcatcaacttagcctggtaccagcagaggcctggccaggctcccagactcctcatctttgatgtttccgacagggccactggtatcccagccaggttcagtggcagtgggtctgggacagaatttactctcaccatcagcagcctgcagtctgaagattttgcaatttattattgtcagcaatataataagtggcccacggtcggccaagggaccagggtggaaatcagg

SEQ ID NO: 1449 - DNA, 375 bp, Homo sapiens; identical to SEQ ID NO: 407

SEQ ID NO: 1450 - DNA, 330 bp, Homo sapiens
cagtctgccctgactcagcctgcctccgtgtctgggtctcctggacagtcgatcaccatctcctgcactggaaccagcagtgacgttggtggttataagtatgtctcctggtaccaacagtacccaggcaaagcccccagactcatgatttatgaggtcactaatcggccctcaggcgtttctaatcgcttctctggctccaagtctggcaacacggcctccctgaccatctctgggctccaggctgaggacgaggctgattattactgcagctcatatagcggcagcaccactgtggttttcggcggagggaccaaggtgaccgtccta

SEQ ID NO: 1451 - DNA, 363 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcccgctccactacggtggtaactcccggttggactactggggccagggaaccctggtcaccgtctcctca

SEQ ID NO: 1452 - DNA, 330 bp, Homo sapiens
cagtctgccctgactcagcctgcctccgtgtctgggtctcctggacagtcgatcaccatctcctgcactggaaccagcagtgatattgggagttataaccttgtctcctggtaccaacagcacccaggcaaaacccccaaactcatgatttatgaggtcagtaagcggccctcaggggtttctaatcgcttctctggctccaagtctggcaacacggcctccctgacaatctctgggctccaggctgaggacgaggctgattactactgcttctcatatgcaggtagtagcacttatgtcttcggaactgggaccaaggtcaccgtccta

SEQ ID NO: 1453 - DNA, 363 bp, Homo sapiens; identical to SEQ ID NO: 1419

SEQ ID NO: 1454 - DNA, 321 bp, Homo sapiens
gccatccagatgacccagtctccatcctccctgtctgcatctgtaggagacagagtcaccatcacttgccgggcaagtcagggcattagaaatgatttaggctggtatcagcagaaaccagggaaagcccctaagctcctgatctatgctgcatccagtttacaaagtggggtcccatcaaggttcagcggcagtggatctggcacagatttcactctcaccatcagcagcctgcagcctgaagattttgcaacttattactgtctacaagattacaattaccccgtgacgttcggccaagggaccaaggtggaaatcaaa

SEQ ID NO: 1455 - DNA, 381 bp, Homo sapiens
caggtgcagctggtgcagtctggggctgaggtgaagaagcctggggcctcagtgaaggtctcctgcaaggcttctggatacaccttcaccagctatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagagtcccgattactatgatagtagtggttatcccctactactacggtatggacgtctggggccaagggaccacggtcaccgtctcctca

SEQ ID NO: 1456 - DNA, 336 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggtttttatgtcttcggaactgggaccaaggtcaccgtccta

SEQ ID NO: 1457 - DNA, 378 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaactctatcatagtgggagcaccaactacaacccgtccctcaagagtcgagtcaccatatcagtagacaagtccaagaaccagttctccctgaagctgagctctgtgaccgccgcggacacggccgtgtattactgtgcgagagtggggccctattactatgatagtagtggttattacaactactttgactactggggcccgagaaccctggtcaccgtctcctca

SEQ ID NO: 1458 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctctcactttcggcggagggaccaaggtggagatcaaa

SEQ ID NO: 1459 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagaccccaagagcagcagctggcaccctgaatacttccagcactggggccagggcaccctggtcaccgtctcctca

SEQ ID NO: 1460 - DNA, 339 bp, Homo sapiens; identical to SEQ ID NO: 522

SEQ ID NO: 1461 - DNA, 357 bp, Homo sapiens
gaggtgcagctcttggagtcggggggaaacttggttcagcctggggactccctgagactctcctgtacagcctttggattcagctttggcagctatgccatgagctgggtccgccaggctcctgggaaggggctggagtgggtctcactcatttatagcggcaatggtaaaacaaagtatgcagactccgtgaagggccggttcaccatctccagagataattccaagaacactctgtatctgcaaatgaacaacctgagagccgacgacacggccgtatattactgtgcaaaagagtataccagtggctggttccttgactactggggccagggaaccctggtcaccgtctcctca

SEQ ID NO: 1462 - DNA, 321 bp, Homo sapiens
gacatccagatgacccagtctccatcttctctgtctgcatctgtaggggacagagtcaccatcacttgtcgggcgagtcaggatattgacaactcattagcctggtatcagcagaaaccggggaaagcccctaaactcctgatctatgctgcatccactttgcaaagaggggtcccatcaaggttcagcggcagtggatctgggacagatttcactctcactatcggcagcctggagcctgaagattttgcaacttactattgtcaacaggctgacagcttcccgctcactttcggcggagggaccaaggtggaaatcaaa

SEQ ID NO: 1463 - DNA, 381 bp, Homo sapiens
caggtgcagctggtgcagtctggggctgaggtgaagaagcctgggtcctcggtgaaggtctcctgcaaggcttctggaggcaccttcagcagctatggtatcagctgggcgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagggcggtctatgcagcaggagacgatgattactactactactacggtatggacgtctggggccaagggaccacggtcaccgtctcctca

SEQ ID NO: 1464 - DNA, 324 bp, Homo sapiens; identical to SEQ ID NO: 590

SEQ ID NO: 1465 - DNA, 357 bp, Homo sapiens
caggtgcggctggtgcaatctgggtctgagttgaggaaacctggggcctcagtgaaaatttcctgcaaggctgctggatacaccttcggtagttataatatgaattgggtgcgacaggcccctggacaaggacttgaatggatgggatggatcaacaccaacactgggaccccaacatatgcccagggctttacaggccgatttgtcttttctttggacacctctgccaacacggcaaatctgcagatcgccagcctacggactggggacactgccgtatatttctgtgcgagagacaccaggtggttgcgaggttttgactactggggccagggaaccctggtcaccgtctcctca

SEQ ID NO: 1466 - DNA, 336 bp, Homo sapiens
cagtctgccctgactcagccagcctccgtgtctggatctcctggacagtcgatcaccatctcctgcactggaaccaccagtgatattgttgattataaccttgtctcctggtaccaacgtcacccaggcgaagcccccaaactcataatttttgagggcagtaagcggcccttagggctttctaatcgcttctctggctccacgtctggcaacacggcctccctgacaatctctgggctcaaggctgaagacgacggtgattattactgctgctcacatggaggtactacgtccccccatgtcgtattcggcggagggaccaagctgactgtccta

SEQ ID NO: 1467 - DNA, 372 bp, Homo sapiens; identical to SEQ ID NO: 107

SEQ ID NO: 1468 - DNA, 321 bp, Homo sapiens
gaaatagtgatgacgcagtctccagccaccctgtctgtgtctccaggggaaagagccaccctctcctgcagggccagtcagagtgttagtagcaacttagcctggtaccagcagaagcctggccaggctcccaggctcctcatctctggtacatccaccagggccactggtatcccagccaggttcagtggcagtgggtctgggacagagttcactctcaccatcagcactctgcagtctgaagattttacagtttattactgtcagcagtctaataactggcccccgacgttcggccacgggaccaaggtggaaatcaaa

SEQ ID NO: 1469 - DNA, 363 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacctcgccggggagcagcaggtccagctggttcgacccctggggccagggaaccctggtcaccgtctcctca

SEQ ID NO: 1470 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtggcgtggtattcggcggagggaccaagctgaccgtccta

SEQ ID NO: 1471 - DNA, 381 bp, Homo sapiens
gaggtgcagctggtggagtctgggggaggcttggtacagcctggggggtccctgagactctcctgtgcagcctctggattcaccttcagtagctatagcatgaactgggtccgccaggctccagggaaggggctggagtgggtttcatacattagtagtagtagtagtaccatatactacgcagactctgtgaagggccgattcaccatctccagagacaatgccaagaactcactgtatctgcaaatgaacagcctgagagacgaggacacggctgtgtattactgtgcgagagatggggggattgtagtagtaccagctgctattgtagcctacggtatggacgtctggggccaagggaccacggtcaccgtctcctca

SEQ ID NO: 1472 - DNA, 321 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtttccctctcactttcggcggagggaccaaggtggagatcaaa

SEQ ID NO: 1473 - DNA, 396 bp, Homo sapiens
caggtgcaggtggtggagtctgggggaggcgtggtccagcctgggaggtccctgagactctcctgtgcagcctctggattcaccttcagtatctatactatgcactgggtccgccaggctccaggcaaggggctggagtgggtggcacttatatcatatgatgggagtgataagtactacgcagactccgtgaagggccgattcaccatctccagagacaattccaagaacacactgtatctacaaatgaacagcctgagagctgaggacacggctatgtattactgtgcgagagggacttattactctggttcggggagttttggaccgcgaattaaaaaagactactacggtatggacgtctggggccaagggaccacggtcaccgtctcctca

SEQ ID NO: 1474 - DNA, 324 bp, Homo sapiens
tcctatgagctgacacagccaccctcggtgtcagtgtccccaggacagacggccaagatcacctgctctggagatgcattgccaaaacaatttacttattggtaccaacagaagccaggccaggcccctgtgctggtgatatatactgacactgagaggccctcagggatccctgagcgattcactggctccagctcagggacaacagtcacattgaccatcagtggagtccaggcagaggacgaggctgactattactgtcaatccgcagacaacagtggcacttatgtggttttcggcggagggaccaagctgaccgtccta

SEQ ID NO: 1475 - DNA, 357 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagacttattactatggttcggggagttgactactggggccagggaaccctggtcaccgtctcctca

SEQ ID NO: 1476 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccccccactttcggcggagggaccaaggtggagatcaaa

SEQ ID NO: 1477 - DNA, 354 bp, Homo sapiens
cagatcaccttgaaggagtctggtccaacgctggtgaaacccacagagaccctcacgctgacctgcaccttctctggcttctctctcactagaactggagaggctgcgggctggatccgtcaggccccaggaagggccctggagtgggtaacagtcattttttgggatgatgataagcgatacagcccttctcttaagaacagactcaccgtcaccaaggacacctccaaaaatcaggtggtccttacaatgaccaacgtggaccctgtggatacagccacatatttctgttgggccatggggggacctggtaatgaatactttggccggggaaccctggtcgccgtctcctca

SEQ ID NO: 1478 - DNA, 336 bp, Homo sapiens
cagtctgtgctgacccagccgccctcagtgtctggggccccggggcagagggtcaccgtctcctgcactgggaccagttccagcatcgggccttactctgatgttcactggtatcagcacatttcaggaagagcccccaggctcctcatctttggaaccagcaatcggccctcaggggtccctgaccgattctctggctccaagtctggcacctcagcctccctggtcatcgcagggctccaggctgaggatgaggctgattattactgccagtcttatgacagcagtctgggtgagatttatgtcttcggaactgggaccacggtcaccgtccta

SEQ ID NO: 1479 - DNA, 360 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggtttcgatagtaattattactacgctgactactggggccagggaaccctggtcaccgtctcctca

SEQ ID NO: 1480 - DNA, 321 bp, Homo sapiens; identical to SEQ ID NO: 156

SEQ ID NO: 1481 - DNA, 381 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgactgccgcggacacggccgtgtattactgtgcgagagagaggggggcgtttgggggagttatcgtcgggagggggatctttgactactggggccagggaaccctggtcaccgtctcctca

SEQ ID NO: 1482 - DNA, 324 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggctcccgatcaccttcggccaagggacacgactggagattaaa

SEQ ID NO: 1483 - DNA, 390 bp, Homo sapiens; identical to SEQ ID NO: 571

SEQ ID NO: 1484 - DNA, 327 bp, Homo sapiens
cagactgtggtgactcaggagccctcactgactgtgtccccaggagggacagtcactctcacctgtgcttccagcactggagcagtcaccagtggttattatccaaactggttccagcagaaacctggacaagcacccagggcactgatttataatacaggcgacaaacactcctggacccctgcccggttctcaggctccctccttggggacaaagctgccctgacactgtcaggtgtgcagcctgaggacgaggctgagtattactgcctgctctactatggtggtcattgggtgttcggcggagggaccaaggtgaccgtccta

SEQ ID NO: 1485 - DNA, 393 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatagaactattggtgaagtggctacgatttttggagtggttattatagattattactttgactactggggccagggaaccctggtcaccgtctcctca

SEQ ID NO: 1486 - DNA, 309 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataggacgttcggccaagggaccaaggtggaaatcaaa

SEQ ID NO: 1487 - DNA, 372 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatacgcccagtgactacgtctactactactacggtatggacgtctggggccaagggaccacggtcaccgtctcctca

SEQ ID NO: 1488 - DNA, 315 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcacggtattcggcggagggaccaagctgaccgtccta

SEQ ID NO: 1489 - DNA, 378 bp, Homo sapiens; identical to SEQ ID NO: 29

SEQ ID NO: 1490 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccgtggtattcggcggagggaccaagctgaccgtccta

SEQ ID NO: 1491 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgtgagagccaccagggggagctactactggggtggggactactggggccagggaaccctggtcaccgtctcctca

SEQ ID NO: 1492 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctcctttcactttcggccctgggaccaaagtggatatcaaa

SEQ ID NO: 1493 - DNA, 384 bp, Homo sapiens
cagctgcagctgcaggagtcgggcccaggactggtgaagccttcggagaccctgtccctcacctgcactgtctctggtggctccatcagcagtagtacttactactggggctggatccgccagcccccagggaaggggctggagtggattgggaatatctattatagtgggagcacctactacaacccgtccctcaagagtcgagtcaccatatcagtagacacgtccaagaaccagttctccctgaagctgagctctgtgaccgccgcggacacggccgtctattactgtgcgagtttattttttgagattacgatttttggagtggttatggggtacggtatggacgtctggggccaagggaccacggtcaccgtctcctca

SEQ ID NO: 1494 - DNA, 324 bp, Homo sapiens
gaaattgtgttgacacagtctccagccaccctgtctttgtctccaggggaaagagccaccctctcctgcagggccagtcagagtgttagcagctacttagcctggtaccaacagaaacgtggccaggctcccaggctcctcatctatgatgcatccaacagggccactggcatcccagccaggttcagtggcagtgggtctgggacagacttcactctcaccatcaacagcctagagcctgaagattttgcagtttattactgtcagcagcgtagcaactggcctcggctcactttcggcggagggaccaaggtggagatcaaa

SEQ ID NO: 1495 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacgactgtgtattactgtgcgagagattcggagagtgatagcagtggctggctacactactttgactactggggccagggaaccctggtcaccgtctcctca

SEQ ID NO: 1496 - DNA, 315 bp, Homo sapiens; identical to SEQ ID NO: 34

SEQ ID NO: 1497 - DNA, 375 bp, Homo sapiens; identical to SEQ ID NO: 437

SEQ ID NO: 1498 - DNA, 330 bp, Homo sapiens
cagtctgccctgactcagcctgcctccgtgtctgggtctcctggacagtcgatcaccttctcctgcactggaaccagcagtgacgttggtggttataactatgtctcctggtaccaacaacacccaggcaaagcccccaaagtcatgatttatgatgtcaggaatcggccctcaggggtttctaatcgcttctctggctccaagtctggcaacacggcctccctgaccatctctgggctccaggctgaggacgaggctgattattactgcagctcatatacaagcagcaacacttatgtcttcggaactgggaccaaggtcaccgtccta

SEQ ID NO: 1499 - DNA, 363 bp, Homo sapiens
caggttcagctggtgcagtctggagctgaggtgaagaagcctggggcctcagtgaaggtctcctgcaaggcttctggttacacctttaccagctttggtatcagctgggtgcgacaggcccctggacaagggcttgagtggatgggatggatcagcgtttacaatgggcacacaaactatgcacagaagctccagggcagagtcaccatgaccacagacacatccacgagtacagcctacatggagctgaggagcctgagatctgacgacacgggcgtgtattactgtgcgagacacggtgaccacgctttttctttgggaattgactactggggccagggaaccctggtcaccgtctcctca

SEQ ID NO: 1500 - DNA, 330 bp, Homo sapiens
cagtctctgctgactcagccaccctcggcgtctgggacccccgggcagagggtcaccatctcttgttctggaagcagctccaacatcggaagtaatgctgaaaactggtaccagcagctcccaggaacggcccccaaactcctcatctatagtaataatcagcgaccctcaggggtccctgaccgattctctggctccaagtctgacacctcagcctccctggccatcagtgggctccagtctgaggatgaggctgattattactgtgcagcatgggatgacagcctaaatggtgtggtattcggcggagggaccaagctgaccgtccta

SEQ ID NO: 1501 - DNA, 351 bp, Homo sapiens
gaggtgcagctggtggagtctggaggaggcttgatccagcctggggggtccctgagactctcctgtgtagcctctgggttcaccgtcagtagcaactacatgagctgggtccgccaggctccagggaaggggctggagtgggtctcaattatttatagcggtagtaccacatcctatgcagactccgtgaagggccgattcaccatctccagagacaattccaagaacacgctgtatcttcaaatgaacagcctgagagccgaggacacggccgtctattactgtgcgagaggtccggaaatttttttccttgactactggggccagggaaccctggtcaccgtctcctca

SEQ ID NO: 1502 - DNA, 315 bp, Homo sapiens; identical to SEQ ID NO: 34

SEQ ID NO: 1503 - DNA, 375 bp, Homo sapiens; identical to SEQ ID NO: 437

SEQ ID NO: 1504 - DNA, 318 bp, Homo sapiens
tcctatgagctgactcagacaccctcagtgtccgtgtccccaggacagacagccagcatcacctgctctggagataaattgggggataaatatgcttgctggtatcagcagaagccaggccagccccctgtgctggtcatctatcaagataataagcgtccctcagggatccctgagcgattctctggctccaactctgggaacacagccactctgaccatcagcgggacccaggctatggatgaggctgactattactgtcaggcgtgggacagcagcgctgtggtattcggcggagggaccaagctgaccgtccta

SEQ ID NO: 1505 - DNA, 384 bp, Homo sapiens; identical to SEQ ID NO: 443

SEQ ID NO: 1506 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtccta

SEQ ID NO: 1507 - DNA, 357 bp, Homo sapiens
gaggtccacctactggagtctgggggagccttcgtacagccgggggggtccctgagactctcctgtgcagcctcaggattcacttttggcgactatgccatgaactgggtccgccagactccagggaagggactggagtgggtctcagttattagtggcagaggaattagcatatattacgcaagttctgtgaagggccggttcaccatctccagagacgatttcgagaacacgctgtatctccaaatgaacagcctgagagtcgaagacacggccctatattattgtgcgaagggcagttatggtgacaacgtccctgaccactggggccagggaaccctggtcgccgtctcccca

SEQ ID NO: 1508 - DNA, 321 bp, Homo sapiens; identical to SEQ ID NO: 6

SEQ ID NO: 1509 - DNA, 378 bp, Homo sapiens
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagatccttactatggttcagggagttattataacgtattggtgcaagactactggggccagggaaccctggtcaccgtctcctca

SEQ ID NO: 1510 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcggacgttcggccaagggaccaaggtggaaatcaaa

SEQ ID NO: 1511 - DNA, 387 bp, Homo sapiens; identical to SEQ ID NO: 391

SEQ ID NO: 1512 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaggtggagatcaaa

SEQ ID NO: 1513 - DNA, 381 bp, Homo sapiens
gaggtgtccctggtggagtctgggggaggcttggtacagccagggcggtccctgagactctcctgtacagcttctggattcacccttggtgattatattataggctggttccgccaggctccagggaaggggccggagtgggttggtttcattagacggagagcctacggtgggacaacgcaatacgccccgtctgtgagaggaagattcagcatctcaagagatgattccaaaagagttgggtatctgcaactgagcagcctgagaaccgaagacactgccatttattactgcgctagagtgatcgatgacaacagctggttcttgggggagtggtatttcgatgtttggggccgtggcgccctggtcagtgtctcctca

SEQ ID NO: 1514 - DNA, 330 bp, Homo sapiens
cagtctatgctgactcagccaccctcagcgtctgggacccccgggcagagggtcacaatttcttgttctggaagcaggtccaacctcggaaataattatgttttctggtaccagcaattccctggaacggcccccaaactcctcatttatagagatagtcggcggccctcaggagtccctgaccgattctctggctccaggtctggcagctcagcctccctggccatcagtgggctccggtccgaagatgaggctgattattattgtgcagcgtgggatgacagcctaagtgactttgttttcgcaactgggaccaaggtcaccgtcctc

SEQ ID NO: 1515 - DNA, 372 bp, Homo sapiens
atggtgcagctgttggagtctgggggaggcttggtacagccgggggggtccctgagactctcctgtgcagcctctggattcacctttagcacccattccctggcctgggtccgccaggctccagggatggggctggaatgggtctcagctattagcgataatgctgttcacatacactactcagactccgtgaagggccggttctccatcgccagagacaattccaagaacacactatatctgcaaatgaacagcctgagagccgaggacacggccgtttatttctgtgtgaaagggacatttgagaggataatagcacctggggggggattgggggcctggggccagggaaccctggtcaccgtctcctca

SEQ ID NO: 1516 - DNA, 321 bp, Homo sapiens
gacatccagatgacccagtctccatcctcattgtctgcatctgtaggagacagaatcaccatcacttgtcgggcgagtcaggacataagtaattatttagcctggtttcagcagaaaccagggaaagcccctaagtccctgatctatggtgcatccagtttgcaaagtggggtcccatcaaagttcagcggcagtggatctgggacagatttcactctcaccatcagcagtctgcagcctgatgactttgcaacttattactgccaacagtatagtgtttaccctctgactttcggcggagggacccaggtggagatcaaa

SEQ ID NO: 1517 - DNA, 381 bp, Homo sapiens; identical to SEQ ID NO: 1357

SEQ ID NO: 1518 - DNA, 324 bp, Homo sapiens
cagtctgtgctgactcagccaccctcagcgtctgggacccccgggcagagggtcaccatctcttgttctggaagcagctccaatatcggaagtaatgctgtaaactggtaccagcagctcccaggaacggcccccaaactcctcatctatagtaattatgagcggccctcaggggtccctgaccgattctctggctccaagtctggcacctcggcctccctggccatcagtggactccagtctgaggatgaggctgtttattactgtgcagcatgggatgacacccgagtggtcttcggcggagggaccaagctgaccgtccta

SEQ ID NO: 1519 - DNA, 363 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaacgctaattagtagtggttatgtatactttgactactggggccagggaaccctggtcaccgtctcctca

SEQ ID NO: 1520 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcagagagtggtattcggcggagggaccaagctgaccgtccta

SEQ ID NO: 1521 - DNA, 384 bp, Homo sapiens
gaggtgcagctggtggagtctgggggaggcttggtccagcctggagggtccctgagactctcctgtgcagcctctggattcatcttcaatgaccactacatggactgggtccgccaggctccagggaaggggctggagtgggttggccgtactagaaacaaagctaacagttacaccacagaatacgccgcgtctgtgaaaggcagattcaccgtctcaagagatgattcaaagaactcactgttcctgcaaatgaacagcctgcaaaccgaggacacggccgtgtattactgtactagagttagtcgccacgttcatagtagtgtttattacaaccgctggtttgactactggggccagggaaccctggtcaccgtctcctca

SEQ ID NO: 1522 - DNA, 321 bp, Homo sapiens
gacatccaaatgacccagtctccatcttctgtgtctgcatctgtaggagacagagtcaccatcacttgtcgggcgagtcagggtattagcaactggttagcctggtatcagcagaaaccagggaaagccccgaagctcctgatctatactgcatccaatttggaaagtggggtcccatcaaggttcagcggcagtggatctgggacagatttcagtctcactatcagcagcctgcagcctgaagattttgcaacttactattgtcaacaggccaacagtttcccctacaccttcggccaagggacacgactggagattgta

SEQ ID NO: 1523 - DNA, 363 bp, Homo sapiens; identical to SEQ ID NO: 413

SEQ ID NO: 1524 - DNA, 330 bp, Homo sapiens; identical to SEQ ID NO: 200

SEQ ID NO: 1525 - DNA, 372 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacgtattactgtgcacggataccggctctatggttcggggagttatcctattatgactactggggccagggaaccctggtcaccgtctcctca

SEQ ID NO: 1526 - DNA, 309 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgagtcactttcggccctgggaccaaagtggatatcaaa

SEQ ID NO: 1527 - DNA, 393 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatgttgagtattacgatttttggagtggttaccgttattactactactactacggtatggacgtctggggccaagggaccacggtcaccgtctcctca

SEQ ID NO: 1528 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcactttcgtcttcggaactgggaccaaggtcaccgtccta

SEQ ID NO: 1529 - DNA, 384 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcgattacagtgggagcacctactacaacccgtccctcaagagtcgagttatcaattcagtagacacgtctaagaaccagttctccctgaagctgagctctgtgactgccgcggacacggccgtgtattactgtgcgagagatccgggtgattactatgatagtagtggttattccaatgatgcttttgatatctggggccaagggacaatggtcaccgtctcttca

SEQ ID NO: 1530 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctctcactttcggcggagggaccaaggtggagatcaaa

SEQ ID NO: 1531 - DNA, 384 bp, Homo sapiens
gaggtgcagctggtggagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagggctcgtctattactatgctagtagtggttattactactcccttgactactggggccagggaaccctggtcaccgtctcctca

SEQ ID NO: 1532 - DNA, 333 bp, Homo sapiens
cagtctgccctgactcagcctgcctccgtgtctgggtctcctggacagtcgatcaccatctcctgcactggaaccagcagtgacgttggtgattataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctcaatgtcttcggaactgggaccaaggtcaccgtccta

SEQ ID NO: 1533 - DNA, 366 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagcccacgtatggttcggggagttattgtaccttgactactggggccagggaaccctggtcaccgtctcctca

SEQ ID NO: 1534 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaatgtggtattcggcggagggaccaagctgaccgtccta

SEQ ID NO: 1535 - DNA, 354 bp, Homo sapiens; identical to SEQ ID NO: 15

SEQ ID NO: 1536 - DNA, 324 bp, Homo sapiens
gaaattgtgttgacacagtctccagccaccctgtctttgtctccaggggaaagagccaccctctcctgcagggccagtcagagtgttagtgactacttagcctggtaccaacagaagcctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcggggcaagtggcccgcgatcaccttcggccaagggacacgactggagattaaa

SEQ ID NO: 1537 - DNA, 387 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagtatattgtggtggtgactgctattcagacgactactactactactacgatatggacgtctggggccaagggaccacggtcaccatctcctca

SEQ ID NO: 1538 - DNA, 321 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtcttcggaactgggaccaaggtcaccgtccta

SEQ ID NO: 1539 - DNA, 366 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcggctattagtggtagtggttatagcacatactacgcagactccgtgaagggccggttcaccatctccagagacaattccaagaacacgctgtatctgcaaatgaacagcctgagagccgaggacacggccgtatattactgtgcgaaatgcctatctactagtggccactactggtacttcgatctctggggccgtggcaccctgatcactgtctcctca

SEQ ID NO: 1540 - DNA, 321 bp, Homo sapiens; identical to SEQ ID NO: 314

SEQ ID NO: 1541 - DNA, 399 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcagggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatatcaactcattgcgcgattacatttgggggagttatcgtaacgtctactactactacggtatggacgtctggggccaagggaccacggtcaccgtctcctca

SEQ ID NO: 1542 - DNA, 330 bp, Homo sapiens; identical to SEQ ID NO: 286

SEQ ID NO: 1543 - DNA, 387 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagagttcttaagcccggtattactatggttcggggagttatattactacggtatggacgtctggggccaagggaccacggtcaccgtctcctca

SEQ ID NO: 1544 - DNA, 339 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcccttattcactttcggccctgggaccaaagtggatatcaaa

SEQ ID NO: 1545 - DNA, 390 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagaggggctacgtattactatggttcggggagttattttcacaatcttgactattttgactactggggccagggaaccctggtcaccgtctcctca

SEQ ID NO: 1546 - DNA, 321 bp, Homo sapiens; identical to SEQ ID NO: 622

SEQ ID NO: 1547 - DNA, 399 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagatttgtatgagaggggttacgatttttggagtggttttgttaatatggcctactactacggtatggacgtctggggccaagggaccacggtcaccgtctcctca

SEQ ID NO: 1548 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcccctttgtcttcggaactgggaccaaggtcaccgtccta

SEQ ID NO: 1549 - DNA, 366 bp, Homo sapiens
caggtgcagctggtgcaatctgggtctgagttgaagaagcctggggcctcagtgaagctttcctgccaggcttctgggtacaccttcactaaccatgctatgaattgggtgcgccaggcccctggacaggggcttgagtggatgggatggatcaacaccaacactgggaacccaacatatgcccagggcttcacaggacggtttgtcttctctttggacacctctgtcggcacggcatatctgcagatcagcagcctaaaggctgaagacactgccttttattactgtgcgagagcgtctgcgcgtccgggtgttgcaacaaacttagacttctggggccagggaaccctggtcgtcgtctcctca

SEQ ID NO: 1550 - DNA, 321 bp, Homo sapiens
gacatccagatgacccagtctccatcctccctgtctgcatctgtaggagacagagtcaccatcacttgccggacaagtcagaatattgacaactatttaaattggtatcagcagaaaccagggaaagcccctaacctcctgatctatgctgcatccagattgcatagtggggtcccatcaaggttcagtggcagtggatctgggacagattttactctcatcatcagcagtctacaacctgaagatcttgcaacttattactgtcaacagagttacagtaatcctctcactttcggccctgggaccaaagtggatatcaga

SEQ ID NO: 1551 - DNA, 366 bp, Homo sapiens
caggtgcagttggaggagtctgggggaggcgtggtccagcctgggaggtccctgagactctcctgtgcagcgtctggattcaccttcagtaattatgccatgcactgggtccgccaggcaccaggcaaggggctggagtgggtggcagctatatggttcgatggaagacagaaagtttatgcagactccgtgaagggccgattcaccatctccagagacaattccaagaacacgctgtatttgcaaatgaacagcctgagagtcgacgacacggctgtatattattgtgcgagagatgtggagcagtggctggtacaggaatatttccagtattggggccatggcaccctggtcaccgtctcctca

SEQ ID NO: 1552 - DNA, 324 bp, Homo sapiens
gaaatagtaatgacgcagtctccagccaccctgtctgtgtctccaggggaaagagccaccctctcctgcagggccagtcagagtataagtagtaatttagcctggtaccagcaaaaacctggccaggctcccaggctcctcatatatggtgcatctaccagggccactggtatcccagccaggttcagtggcagtgggtctgggacagagttcagtctcaccatcagcagcctgcagtcggaagattttgcagtttactactgtcagcagtataataatcggcctccggcgacttttggccaggggaccaagctggagatcaaa

SEQ ID NO: 1553 - DNA, 366 bp, Homo sapiens
caggtgcagctggtggagtctgggggaggcgtggtccagcctgggaggtccctgagactctcctgtgcagcctctggcttcaccttcagtacctatgctatgcactgggtccgccaggctccaggcaaggggctggagtggttggcaataacatcatatgatggaagcaataaatactacgcagactccgttaagggccgattcattatttccagagacaattccaagagcacgctgtatttgcaaatgaacagcctgagacctgaggacacggctgtgtattactgtgcgagagatttgacaaggtgggagctacactacttctttcactactggggccagggaaccctggtcaccgtctcctca

SEQ ID NO: 1554 - DNA, 321 bp, Homo sapiens
gagattgtgttgacacagtctccagccaccctgtctttgtctccaggggaaagagccaccctctcctgcagggccagtcagagtgtgagcagctacttagcctggtaccagcagaaacctggccagcctcccaggctcctcatctatgatgcatccaacagggccactggcatcccagccaggttcagtggcagtgggtctgggacagacttcactctcaccatcagcagcctggagcctgaagattttgcagtttattactgtcagcaccgtaacgactggcctccggggttcggccaagggacgcgactggagattaaa

SEQ ID NO: 1555 - DNA, 372 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattggcagtatctattatagtgggatcacctactacaacccgtccctcaagagtcgagtcaccatatccgtagacacgtccaagaaccagttctccctgaggctgagctctgtgaccgccgcagacacggctgtgtattactgtgcgagacaagggaggtatagtgggagccatgggcattctttcgacccctggggccagggaaccctggtcaccgtctcctca

SEQ ID NO: 1556 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcacccctgtcttcggaactgggaccaaggtcaccgtccta

SEQ ID NO: 1557 - DNA, 384 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcgagcgtattatgattacatttgggggagttatcggccatacggtatggacgtctggggccaagggaccacggtcaccgtctcctca

SEQ ID NO: 1558 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccctggacgttcggccaagggaccaaggtggaaatcaaa

SEQ ID NO: 1559 - DNA, 357 bp, Homo sapiens
caggtgcagctggtgcagtctggggctgaggtgaagaagcctggggcctcagtgaaggtctcctgcaaggcttctggatacacattcaccagtgacgatatgaactgggtgcgacaggccactggacaggggcttgagtggatgggatggatgaacccttacagtggtaacacaggctatgcacagaagttccagggcagagtcaccatgaccaggaacacctccataagcacagcctacttggagctgagcagcctgagatctgacgacacggccgtgtattactgtgcgagagggatggatcggaattccccgggcgactactggggccagggaaccccggtcaccgtctcctca

SEQ ID NO: 1560 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtgttccaaggacgttcggccaagggaccaaggtggaaatcaaa

SEQ ID NO: 1561 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagaggggggagtgggagctacttgtcctggttcgacccctggggccagggaaccctggtcaccgtctcctca

SEQ ID NO: 1562 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgggaacgttcggccaagggaccaaggtggaaatcaaa

SEQ ID NO: 1563 - DNA, 369 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagaaggcgcgtggggtggtgacgcgacagatgcttttgatatctggggccaagggacaatggtcaccgtctcttca

SEQ ID NO: 1564 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactcgggtattcggcggagggaccaagctgaccgtccta

SEQ ID NO: 1565 - DNA, 375 bp, Homo sapiens
gaggtgcagctggtggagtctggaggaggcttgatccagcctggggggtccctgagactctcctgtgcagcctctggattcaccgtcagtagcaactacatgagctgggtccgccaggctccagggaaggggctggagtgggtctcagttatttatagcggtggtagaacatactacgcagactccgtgaagggccgattcaccatctccagagacaattccaagaacacgctgtatcttcaaatgaacagcctgagagccgaggacacggccgtgtattactgtgcgagagacattctttctaccaatacggtgacttaccccgctgatgcttttgatatctggggccatgggacaatggtcaccgtctcttca

SEQ ID NO: 1566 - DNA, 330 bp, Homo sapiens
cagtctgccctgactcagcctgcctccgtgtctgggtctcctggacagtcgatcaccatctcctgcactggaaccagcagtgacgttggtgtttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcactctggtattcggcggagggaccaagctgaccgtccta

SEQ ID NO: 1567 - DNA, 381 bp, Homo sapiens
gaggtgcagctgttggagtctgggggaggcttggtacagcctggggggtccctgagactctcctgtgcagcctctggattcacctttagcaactatgccatgagctgggtccgccaggctcctgggaaggggctggagtgggtctcacttatctataccggtgttcctagcacatactatgcagactccgtgaagggccggttcaccatctccagagatgaatccaagaaaaggctgtatctgcaaatgaacagcctgagagccgaggacacggccgtttatttctgtgtggggggagattgtagtagtaccagctgccagggtggctactactacggcctggacgtctggggccaagggaccacggtcaccgtctcctca

SEQ ID NO: 1568 - DNA, 321 bp, Homo sapiens
gacatccagatgacccagtctccatcctccctgtctgcatctgtaggagacagagtcaccatcacttgccgggcaagtgagaacattaacatctatttaaattggtatctgcagaaaccagggaaagcccctaagctcctgctctatgctgcgtccagtttgcaaagtggggtcccatcgaggttcagtggcagtggatctgggacagatttcactctcaccatcagcagtctgcaacctgaagattttgcgatttactactgtcaacagagttacagtacccctctcactttcggcggagggaccaaggtggagatcaaa

SEQ ID NO: 1569 - DNA, 378 bp, Homo sapiens
caattggagctggtgcagtctgggcctgaggtgaaaaagcctgggacctcagtgaaggtctcctgcaagacctctggattcacctttacgacgtctgctgtgcagtgggtgcgacaggttcgtggacagcgccttgagtggataggttcgatcgtcgttggcagcggtaacacaaactacgcgcagacgctgcaggaaagagtcaccattagtagggacctcttaagaagtacagcctacatggagctgagcagcctgagatccgaggacacggccatttacttctgtgcgacggctcgaattactctgcttcggggaagtgtcatctccgatgcttttgatatgtggggccaggggacaatggtcaccgtctcttcg

SEQ ID NO: 1570 - DNA, 321 bp, Homo sapiens
gacatccagatgacccagtctccatcctccctgtctgcatctgtaggcgacagagtcaccatcacttgccgggcgagtcagggcattagcaattatttagcctggtatcagcagaaaccagggaaagctcctaagctcctgatctatggtggatcctctttgcaatctggggtcccatctcggttcagtggcagtgggtctgggacagatttcactctcaccatcaacagccttcagcctgaagatgttgcaacttatcactgtcaaaactataacagtgccctcctcactttcggcggagggaccaaggtggagatcaaa

SEQ ID NO: 1571 - DNA, 351 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatgttcagctggcccttgactactggggccagggaaccctggtcaccgtctcctca

SEQ ID NO: 1572 - DNA, 324 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattatgtcttcggaactgggaccaaggtcaccgtccta

SEQ ID NO: 1573 - DNA, 384 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggaccaccttcaaattacgatattttgactggttattacccgtactactttgactactggggccagggaaccctggtcaccgtctcctca

SEQ ID NO: 1574 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctcaaacttttggccaggggaccaagctggagatcaaa

SEQ ID NO: 1575 - DNA, 354 bp, Homo sapiens
caggtgcagctggtggagtctgggggaggcgtggtccagcctgggaggtccctgagactctcctgtgcagcctctggattcaccttcagtagctatgctatccactgggtccgccaggctccaggcaaggggctggagtgggtggcacttatatcatatgatggaggtaataaatactacgcagactccgtgaagggccgattcaccatctccagagacaattccaagaacacgctgtatctgcaaatgaacagcctgagagctgaggacacggctgtgtattactgtgcgagagtcatggggggatccggtatggacgtctggggccaagggaccacggtcaccgtctcctca

SEQ ID NO: 1576 - DNA, 318 bp, Homo sapiens; identical to SEQ ID NO: 52

SEQ ID NO: 1577 - DNA, 393 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcccgtgccgtattactatgatagtagtggttattactacgggggtggtgactactttgactactggggccagggaaccctggtcaccgtctcctca

SEQ ID NO: 1578 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagcttctgatctataaggcgtctagtttagaaagtggggtcccatcaaggttcagcggcagtggatctgggacagaattcactctcaccatcagcagcctgcagcctgatgattttgcaacttattactgccaacagtataatagttattcaaagacgttcggccaagggaccaaggtggaaatcaaa

SEQ ID NO: 1579 - DNA, 363 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagctattggaagcagctggtacaggggggatgactactggggccagggaaccctggtcaccgtctcctca

SEQ ID NO: 1580 - DNA, 324 bp, Homo sapiens; identical to SEQ ID NO: 56

SEQ ID NO: 1581 - DNA, 381 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatctcctgggttactatgatagtagtggttattactactccgctgcttttgatatctggggccaagggacaatggtcaccgtctcttca

SEQ ID NO: 1582 - DNA, 333 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggcctttatgtcttcggaactgggaccaaggtcaccgtccta

SEQ ID NO: 1583 - DNA, 369 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatccgatttacgatttttggagtgagtactactttgactactggggccagggaaccctggtcaccgtctcctca

SEQ ID NO: 1584 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttttgtggtattcggcggagggaccaagctgaccgtccta

SEQ ID NO: 1585 - DNA, 354 bp, Homo sapiens
caggtccacctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaaccgggtacggttcggggagttatttgttctggggccaagggacaatggtcaccgtctcttca

SEQ ID NO: 1586 - DNA, 321 bp, Homo sapiens
gacatccagatgacccagtctccttccaccctgtctgcatctgtaggagacagagtcaccatcacttgccgggccagtcagagtattagtagttggttggcctggtatcagcagaaaccagggaaagcccctaagctcctgatctataaggcgtctagtttacaaagtggggtcccatcaaggttcagcggcagtggatctgggacagaattcactctcaccatcagcagcctgcagcctgatgattttgcaacttattactgccaacagtataatagttattctcgaacgttcggccgagggaccaaggtggacatcaaa

SEQ ID NO: 1587 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaggaataagtgggagctactatcctccctatgactactggggccagggaaccctggtcaccgtctcctca

SEQ ID NO: 1588 - DNA, 318 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggtggacgttcggccaagggaccaaggtggaaatcaaa

SEQ ID NO: 1589 - DNA, 384 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagagctctggtagtaccagctgctatgcttgttgattactactactacggtatggacgtctggggccaagggaccacggtcaccgtctcctca

SEQ ID NO: 1590 - DNA, 333 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgaggaggtattcggcggagggaccaagctgaccgtccta

SEQ ID NO: 1591 - DNA, 375 bp, Homo sapiens
caggtgcagctgcaggagtcgggcccaggactggtgaagccttcacagaccctgtctctcacctgcactgtctccggtggctccatcagtagtggtgcttactactggagctggatccgccagcacccagggaagggcctggagtgggttgcctacatgtatttcactgggaccactttttacaacccgtccctccagagtcgactatccatttcagaagacacgtctaagaatcagctgtctctgaggctgagctctgtgactgccgcggacacggccgtctattactgtgcgaggtcgtcccgtgacagtagtcgggactactactacggtatggacgtctggggccaagggaccacggtcaccgtctcctca

SEQ ID NO: 1592 - DNA, 315 bp, Homo sapiens
tcctatgaactgactcagccaccctcagtgtccgtgtccccaggacagacagccagcatcacctgctctggagataacttgggggataaatatacttactggtatcaacagaagacaggccagtcccctgtgctggtcatctatcaagattccaagcggccctcagggatccctgagcgattctctgcctccaactctgggaacacagccactctgaccatcagcgggacccaggctatggatgaggctgactattattgccaggcgtgggacagcagaatcctcttcggcggagggaccaagctgaccgtccta

SEQ ID NO: 1593 - DNA, 387 bp, Homo sapiens
caggtgcagctgcaggagtcgggcccaggactggtgaagccttcacagaccctgtccctcacctgcactgtctctggtggctccatcagcagtggtgattactactggagctggatccggcagcccgccgggaagggactggagtggcttgggcgtatctataccagtgggagcaccaactacaacccctccctcaagagtcgagtcaccatatcagtagacacgtccaagaaccagttctccctgaaactgacctctgtgaccgccgcagacacggccgtgtattactgtgcgggcctatattgtagtggtggtagctgcccatttgcctccttctactacggtatggaggtctggggccaagggaccacggtcaccgtctcctca

SEQ ID NO: 1594 - DNA, 333 bp, Homo sapiens
cagtctgtgctgactcagccaccctcagcgtctgggacccccgggcagagggtcaccatctcttgttctggaagcagctccaacatcggaagtaatactgtaaactggtaccatcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggcctttatgtcttcggaactgggaccacggtcaccgtccta

SEQ ID NO: 1595 - DNA, 366 bp, Homo sapiens
cagttgcagctgcaggagtcgggcccaggactggtgaggccttcggagaccctgtccctcagttgttctgtctctggtgactccatgagtagtggtgcttactattgggcctggatccgccagcccccagggaaggggctggagtggattgctagtctttataacagtgcgagtactgtctacaccccgtccctcaagagtcgtctcaccatatcaatggacacgtccaagaaccagttctccctgagcctgacctctgtgaccgccgcggacacggccgtctattactgtgcgagaaacagaagtgtcgcgggaagttctttttttgacttctggggccagggaacccgggtcaccgtctcctca

SEQ ID NO: 1596 - DNA, 339 bp, Homo sapiens
gacatcgtgatgacccagtctccagactccctggctgtgtctctgggcgagagggccactatcaactgcaagtccagccagactattttttccacctccaacaataagaactacttaacttggtaccagcacaaagcaggacagcctcctaaattgctcatttactgggcatctacccgggactccggggtccctgaccgattcagtggcagcggatctgggacagatttcactctcaccatcaccagcctgcaggctgaagatgtggcagtttattactgtcaccaacattatagttttcctgtcacttttggccaggggaccaagctggagatcaaa

SEQ ID NO: 1597 - DNA, 348 bp, Homo sapiens
gaggtgcaactggtggagtctgggggagtcttggtacagccaggggggtccctgagactctcctgtgcagcctcgggattctccttcaccacttacgacatgcactgggtccgccaaggcacgggacaaggtctggagtgggtctcaggcattggcactgctggtgatacatattattcagactccgtgaagggccgatgcaccatctccagagacaatgccaagaactccttgtatcttcaaatgaagagcctgagagccgcggacagggctgtgtattattgtgcaaggggggtgggtggaattatcgactactggggccagggaaccccggtcaccgtctcctca

SEQ ID NO: 1598 - DNA, 330 bp, Homo sapiens
aattttgtgctgactcagccccactctgtgtcggagtctccggggaagacggtaaccatctcctgcaccggcaacagtggcagcattgccaccaagtatgtacagtggttccagcagcgcccgggcagtgcccccaccactgtgatctatgaagataaccaaagaccctctggggtccctgatcggttctctggctccagcgacagctcctccaactctgcctctctcaccatctctggactgaagactgaagacgaggctgattactactgtcagtcttatcataacaggcgctgggtgttcggcggagggaccaagttgaccgtccta

SEQ ID NO: 1599 - DNA, 381 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtctattactgtgcgacccgtatgttctcttgggggaattatcgcgaagttgggtactactttgactactggggccagggaaccctggtcaccgtctcctca

SEQ ID NO: 1600 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtccta

SEQ ID NO: 1601 - DNA, 369 bp, Homo sapiens
caggtgcaactggtgcagtctggggctgaggtgaagaagcctggggcctcagtgaaggtctcctgcaaggcttctggatacactttcaccgaccactatatacactgggtgcgacaggcccctggacaagggcttgagtggatgggatggatcaaccctaacagtgggggcacaaaatatggacagaagtttcagggcagggtcaccatgaccagggacacgtccatcaccacagcctacatggacctgggcaggctgagatctgacgacacggccgtctattactgtgcgagagaggcggcctatggttcggggaatttgaactggttcgacccctggggccagggaaccctggtcaccgtctcctca

SEQ ID NO: 1602 - DNA, 330 bp, Homo sapiens
aattttatgctgactcagccccactctgtgtcggagtctccggggaagacggtgaccatctcctgcaccggcagcagtggcagcattgccagcaactatgtgcactggtaccagcagcgcccgggcagtgcccccaccactgtgatttatgaggataaccaaagaccctctggggtccctgatcggttctctggctccatcgacagctcctccaactctgcctccctcaccatctctggactgaagactgaggacgaggctgactactattgtcagtcttatgatagcgactcctgggtgttcggcggagggaccaagctgaccgtccta

SEQ ID NO: 1603 - DNA, 366 bp, Homo sapiens
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcacccggtatagcagctcgtgatcgctggttcgacccctggggccagggaaccctggtcaccgtctcctca

SEQ ID NO: 1604 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagccaccaggggtacacttttggccaggggaccaagctggagatcaaa

SEQ ID NO: 1605 - DNA, 390 bp, Homo sapiens
caggtacagctacaggagtcgggcccaggactggtgcggccttcggagaccctgtccctcacatgcagtgtctctggtggcttcacgagtgactactactggagttggatacggcagcccgccgggaagggactggagtggattgggcgcatctttagtagtgtgagcaccaattacaacccctccctgaagagtcgagtcaccatgtcagtggacacgtccaggagccagttctccctgcagctggactctgtgaccgccgcggacacggccgtgtattactgtgcgagaggtcggattaccctcaattatgcctcgggaaggaactcaaacttctactattatggtatggacgtctggggccaagggaccacggtcaccgtctcctca

SEQ ID NO: 1606 - DNA, 321 bp, Homo sapiens
gacatccagatgacccaatctccatcctccctgtctgcctctgtgggagacagagtcaccttcacttgccgggcaagtcagaccattaccaattatttaaattggtatcagcagaaaccagggaaagcccctaagctcctgatctatgctgcatccactttgcaaagtggggtcccatcaaggttcagtggcagtggatctgggacagatttcactctcaccatcagcagtctgcaacctgaagattttgcaacctactactgtcaacagagttacagtacccctctaactttcggccctgggaccaaagtggacatcaga

SEQ ID NO: 1607 - DNA, 369 bp, Homo sapiens
caggaccagctggtgcaatctggggctgaggtgaagaagcctgggtcctcggtgaaggtctcctgccaggcttctggaggcaccttcgacacctatactgtcagctgggtgcgacaggcccctggacaagggcttgagtggatgggaaggatcatccctatgcttggaatcgttaactacgcacggaagtttcagggcagagtcacgataaccgcggacaagtccacgggcacagcctacctggatgtgacctccctgatatctaatgacacggccgtgtacttctgtgcgagagaccgtgggagttattcgagccgcgaatggtacttcgatctctggggccgtggaaccctggtcacggtctcctcg

SEQ ID NO: 1608 - DNA, 321 bp, Homo sapiens
gacatccagatgacccagtctccatcctccctgtctgcatcagtcggcgacagagtcaccatcacttgccgggcgagtcagggcattagtaattatttagcctggtatcagcagaaaccagggagagtgcctgagctcctgatctatggtgcatccactttgcactcaggggtcccgccccgattcagtggcagtggatctgggacagatttcactctcaccatcagcagcctacagcctgaagatgttgcaacttatttctgtcaaaattataatactgccctccggggattcggccaggggaccaaggtggaaatcaaa

SEQ ID NO: 1609 - DNA, 378 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagatgaaggtgggagctacttgggggactactactactacggtatggacgtctggggccaagggaccacggtcaccgtctcctca

SEQ ID NO: 1610 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgccgtggtattcggcggagggaccaagctgaccgtccta

SEQ ID NO: 1611 - DNA, 381 bp, Homo sapiens
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaatcctaacagtggtaacacaggctatgcacagaagttccagggcagagtcaccatgaccaggaacacctccataagcacagcctacatggagctgagcagcctgagatctgaggacacggccgtgtattactgtgcgagaggcgcgagtattacgatttttggagtggttattcaatactacggtatggacgtctggggccaagggaccacggtcaccgtctcttca

SEQ ID NO: 1612 - DNA, 315 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaggacgttcggccaagggaccaaggtggaaatcaaa

SEQ ID NO: 1613 - DNA, 372 bp, Homo sapiens
gaggtgcagctggtggagtctgggggaggcttggtccagcctggggggtccctgagactctcctgtgcagcctctcaattcacctttagtaactattggatgagctgggtccgccaggctccagggaaggggctggagtgggtggccaacataaaacaagatggaagcgacaaatactatgtggactctgtgaagggccgattcaccatctccagagacaacgccaagaactcactgtatctgcaaataaacagcctgagagccgaggacacggctctgtattactgtgcgagaggcttgcgtcaatatagtaccagggactactacggtatggacgtctggggccaagggaccacggtcaccgtctcctca

SEQ ID NO: 1614 - DNA, 333 bp, Homo sapiens
cagtctgtgctgacgcagccgccctcagtgtctggggccccagggcagagggtcaccgtctcctgcactgggagcagctccaacatcggggcaggttatgatgtacagtggtaccagcagcttccaggaacagcccccaaactcctcatctatgctaacagcaatcggccctcaggggtccctgaccgattctctggctccaagtctggcaccgcagcctccctggccatcactgggctccaggctgaggatgaggctgattattactgccagtcctatgacaccggcctgcgtggttcggtgttcggcggagggaccaagctgaccgtccta

SEQ ID NO: 1615 - DNA, 372 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatggacaaagcagtggctggcccggggatgatgcttttgatatctggggccaagggacaatggtcaccgtctcttca

SEQ ID NO: 1616 - DNA, 324 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcattgggtgttcggcggagggaccaagctgaccgtccta

SEQ ID NO: 1617 - DNA, 366 bp, Homo sapiens
caggtgcagctggtgcagtctgggtctgacttgaagaagcctggggcctcagtgaaggtttcctgccagacttctgggtacaccttcacagaccacgctatgaattgggtgcgacaggcccctggacaggggcttgagtggctgggatggatcaacaccaacactggtaacccaacatatgcccaggacttcccaggacgctttgtcttctccttggacacctctgtcagcacggcatatctgcagatcagtcgcctacaggctgatgacactgccgtttatttctgtgcgagagcgtctgcgcgtccgggtgttgcaaccaactttgattactggggccagggaaccctggtcatcgtctcctca

SEQ ID NO: 1618 - DNA, 321 bp, Homo sapiens
gacatccagatgacccagtctccatcctccctgtctgcatctgtaggagacagagtcaccatcacttgccgggcaagtcagagcattgacaactatttaaattggtatcaacaaaaaccagggaaagcccctagcctcctcatctatgctgcatccaggttgcatagtggggtcccatcaaggttcagtggcactggatctgggacagattttactctcatcatcagtagtctacaacctgaagatcttgccacttattactgtcaacagagttacagtaaccctcttactttcggcccagggaccaaagtggatatcaga

SEQ ID NO: 1619 - DNA, 366 bp, Homo sapiens
gaagtgcagctggtggagtctgggggaggcttggtacagcctggcaggtccctgagactctcctgtgcagcctctggattcaactttcatgattatgccatgcactgggtccggcaagctccagggaagggcctggagtgggtctcaggtattaattggaatagtggtgagatagtctatgcggactctgtgaagggccgattcaccatctccagagacaacgccaagaactccctgtttctgcaaatgaaccgtctgaaaactgaagacacggccttctattactgtgctaaagatagtgtggttcggggagtctatgattcttttgatttctggggccaagggacaatggtcaccgtctcttca

SEQ ID NO: 1620 - DNA, 321 bp, Homo sapiens
gacatccagatgacccagtctccatcctccctgtctgcatctataggagacagagtcaccatcacttgccggtcaagtcagagcattatcacctatttaaattggtttcagcacataccagggaaagcccctaaactcctgatctatgctgcatccagtttgcaaagtggggtcccttcaaggttcagtgccagtggatctgggacagatttcacactcaccatcggcagtctgcaacctgaagattttgctacttactactgtcaacagagttacagtctccctctcactttcggcggagggaccaaggtggagatcaga

SEQ ID NO: 1621 - DNA, 366 bp, Homo sapiens
gaagtgcagctggtggaatctgggggaggcttggcacagcctggcaggtccctgagactctcctgtgaagcatctggattcaactttcatgactatggcatgcactgggtccggcaagctccagggaagggcctggagtgggtctcaggtatcggttggaatagtgctactataggctatgcggactctgtgaagggccgcttcatcatctccagagacaacgccaagaagtccctgtatttgcaaatgaacagtctgagacctgacgacacggccttctattattgtgtaaaagggagtggaatttcactttggggtgtctggttcgacccctggggccagggaaccctggtcaccgtctcctca

SEQ ID NO: 1622 - DNA, 321 bp, Homo sapiens
gacatccagatgacccagtctccatcttccgtgtctgcatctgtaggagacacagtcaccatcacttgtcgggcgagtcaagatattagtacctggttagcctggtatcagcagaaaccagggagagtccctgagctcctgatctatactgcatccagtttgcaaagtggggtcccatcaaggttcagcggcagtggatctgggacagatttcactctcaccatcagcagcctgcagcctgaagattttgcaacttacttttgtcaacaggctaacggtttccctttcactttcggccaggggaccaggctggagatgaaa

SEQ ID NO: 1623 - DNA, 363 bp, Homo sapiens
caagtgcacctggtggagtctgggggaggcgtggtccagcctgggaggtccctgagactctcctgtgcagcctctggattcaccttcagtgactacgctatacactgggtccgccaggctccaggcaaggggctggagtgggtggcagttatatcatatgatggaaggaataaattttacacagactccgtgaagggccgattcaccatctccagagacaattccaagaacactctgtatctgcaaatgaacagcctgagttctgaggacacggctatgtattactgtgcgagagtggcccaccagtacggtggcccctactttgactactggggccagggaaccctggtcaccgtctcctca

SEQ ID NO: 1624 - DNA, 321 bp, Homo sapiens
gacatccagatgacccagtctccatcttctgtgtctgcatctgtaggagacagagtcaccatcacttgtcgggcgagtcagggtattaacagttggttagcctggtatcagcagaaaccagggaaagcccctaaactcctgatctattctgcatccaatttgcaaagtggggtcccatcaaggttcagcggcagtggatctgggacagatttcactctcactatcagtagcctgcagcctgaagattttgcaacttactattgtcaacaggctaacagtttcccgtacacttttggccaggggaccaagctggagatcaga

SEQ ID NO: 1625 - DNA, 369 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttcactattgtggtggtgattgctgtacgaattgactactggggccagggaaccctggtcaccgtctcctca

SEQ ID NO: 1626 - DNA, 333 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcagtcagggggtgttcggcggagggaccaagctgaccgtccta

SEQ ID NO: 1627 - DNA, 360 bp, Homo sapiens
caggtgcaacttcaggaggcgggcccaggactggtgaggccttcggagaccctggcgctcacttgcaatgtctctggtcattccatcagtagtggtcattactggagctggatccggcaggccccagggaagcaactggagtggattggcaatgtcaatcgtattgggaccacatattacaatccgtcccttaagaatcgagtcatcatatcagtggacacgtccaagaaccaggtgtccctgaagctgacctctgtgaccgccgcagacacggccgtatatttctgtgcgagagacgcagcaggtccgatgagtggcatggacgtctggggccaagggaccatggtctccgtctcctca

SEQ ID NO: 1628 - DNA, 330 bp, Homo sapiens
gcctatgtcctcactcagccaccgtctgtgacggtggccccaggaaagacggccaacatttcctgtgggggagacaacattgaaagtcaaagtgtgcactggtaccagcagaagccaggccaggcccctgtacgggtcatcttttatgatatcgaccggccctcagggatccctgagcgattctctggctccacctctggaaacacggccaccctgaccatcagccgcgtcgaggccggggatgaggccgactacttctgtcaggtgtgggatagtagtagtcttcatccgggttatgtcttcggaagtgggaccacggttttcgtccta

SEQ ID NO: 1629 - DNA, 390 bp, Homo sapiens
cagctgcagctgcaggagtcgggcccaggactggtgaagccttcggagaccctgtccctcacctgcactgtctctggtggctccatcagcagtagaagttactactgggcctggatccgccagcccccagggaaggggctggagtggattgggaatatttatggtagtgggagcgcctactacaacccgtccctcaagagtcgagtcgccatatcagtagacacgtccaagaaccagttctccctgaagctgacctctgtgaccgccgcggacacggccgtctattactgtgcgagagaggccgtagtggtggtacctgctacgcctaactcccggggaggaggagaggttgactcctggggccagggaaccctggtcaccgtctcctca

SEQ ID NO: 1630 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtacctgcagaaaccaggacaccctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgaacacttttggccaggggaccaagctggagatcaaa

SEQ ID NO: 1631 - DNA, 363 bp, Homo sapiens
caggtgcagctggtggagtctgggggaggcgtggtccagcctgggaggtccctgagactctcctgtgcagcctctggattcatcttcaatgcctatgctatgcactgggtccgccaggctccaggcaaggggctggagtgggtggcagtcacatcctatgatggaaacaagaaacactacgcagactccgtgaagggccgattcaccatctccagagacaattccaagaacacgctgtatctgcaaatgaacagcctgagacctgaggacacggctgtttattactgtgcgaaagatgaatatagtggctacgatttgatcatcggctactggggccagggaacccgggtcaccgtctcctca

SEQ ID NO: 1632 - DNA, 330 bp, Homo sapiens
aattttatgctgactcagccccactctgtgtcggagtctccggggaagacggtcaccatctcctgcaccggcagcagtggcagcattgccggcaactatgtgcagtggtaccagcagcgcccgggcagtgcccccaccactgtgatctatgagcataaccaaagaccctctggggtccctgatcggttctctggctccttcgacagctcctccaactctgcctccctcaccatctctggactgaagactgaggacgaggctgactactactgtcagacttatgatagcagtacagtggtcttcggcggagggaccaagctgaccgtgcta

SEQ ID NO: 1633 - DNA, 372 bp, Homo sapiens
cagatcaccttgaaggagtctggtcctccactggtgagacccactcagaccctcacgctgacctgcaccttctctgggttttcactcagtagaacaggagtgggtgtgggctggatccgtcagcccccaggcaaggccctggagtggcttgcactcatttattgggatggtgatgagcgctacaacccatctctgaagactagactcaccatcaccaagaacacctccaaaaatcaggtggtccttatgatggccaaaatggaccctgcggacacagccacttactactgtcttcacagcctgacgacctttggactgcccgactacgctgtggacgtgtggggccaagggaccccggtcaccgtctcctca

SEQ ID NO: 1634 - DNA, 324 bp, Homo sapiens
gaaatagtaatgacgcagtctccagccaccctgtctgtgtctcccggggacagagccacgctctcctgcagggccagtcggagtgttgacaccaacttagcctggtaccgccagaaacctggccagcctcccaccctcctcatttatggtgcatcgaccagggccactggtatcccagccaggttcagtggcagtgggtctgagacagacttcactctcaccatcagcagcctgcagtctgacgattttgcagtttattactgtcagcagtataataactggccttggatcaccttcggccaagggacacgactggagattaaa

SEQ ID NO: 1635 - DNA, 360 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaactacaacccgtccctcaagagtcgagtcaccatatcagtagacaagtccaagaaccagttctccctgaagctgagctctgtgaccgccgcggacacggccgtgtattattgtgcgagattcatcggtagtggttattaccattttgactactggggccagggaaccctggtcaccgtctcctca

SEQ ID NO: 1636 - DNA, 324 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcatagggtgttcggcggagggaccaagctgaccgtccta

SEQ ID NO: 1637 - DNA, 390 bp, Homo sapiens
gaggtgcagctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagattcggtgtcgccgtattactatgatagtagtggttattactaccatcggtactttgactactggggccagggaaccctggtcaccgtctcctca

SEQ ID NO: 1638 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcaccgtggtattcggcggagggaccaagctgaccgtccta

SEQ ID NO: 1639 - DNA, 366 bp, Homo sapiens
caggtgcagctgcaggagtcgggcccaggactggtgaagccttcacagaccctgtccctcacctgcactgtctctggtgcctccatcagcagtggtagttactactggaactggatccggcagcccgccggaaagggactggagtggattgggcgtatatataccagtagtaccactaattacaaccccgccctcgagagtcgactcactatgtcagtcgacatgtccaggaaccagttctccctgaagctgacctctgtgaccgccgcagacacggccgtctattactgtgcgagaacggactgtggtggtgattgccattcgcttgcctactggggccagggaactctggtcaccgtctcctca

SEQ ID NO: 1640 - DNA, 306 bp, Homo sapiens
gaagttgtattgacacagtctccagccaccctgtctttgtctccaggggaaagagccaccctcttctgcagggccagtcagattgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcatctcgctttcggcggagggaccaaggtggagatcaaa

SEQ ID NO: 1641 - DNA, 369 bp, Homo sapiens
caggtgcagctggtggagtctgggggaggcgtggtccagcctgggaggtccctgagactctcctgtgcagcctctggattcaccttcaggaactatgccatgcactgggtccgccaggctccaggcaaggggctggagtgggtggcagttatatcatacgatggaagtaataaatactatgcagactccgtgaagggccgattcaccatctccagagacaaatccaagaacacgctgcatctacaaatgaacagcctgagagctgaggacacggctgtctattactgtgcgaaagattggggagacggtatagtgggacctactacggttgactactggggccagggaaccctggtcaccgtctcctca

SEQ ID NO: 1642 - DNA, 321 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaaggtcctgacctcctgatctatgctgcatccactttgcaatcaggggtcccatctcggttcagtggcagtggatctggcacagatttcactctcaccatcagcagcctgcagcctgaagattttgcaacttattactgtcaaaagtataacagtgccccgtggacgttcggccaagggaccaaggtggaaatcaaa

SEQ ID NO: 1643 - DNA, 396 bp, Homo sapiens
caggtgcagctggtgcagtctggggctgaagtgaagaagcctggggcctcagtgatggtctcctgcaaggcttctggatacaccttcaccggttaccatatgcactgggtgcgacaggccccaggacaagggcttgagtggatgggatggatcaaccctagcactggtggcacaaactatgcacagaagtttcaggacagggtcaccgtgaccagggacacgtccatcagcacagcctacatggagctgagcaggctgagatctgacgacacggccgtgtattattgtgcgagccagagggtcacttctgggtatagcagtggctggtatttttccgaactgaaagtttatggtttggacgtctggggccaagggaccacggtcaccgtctcatca

SEQ ID NO: 1644 - DNA, 327 bp, Homo sapiens
gaaattgtgttgacgcagtctccaggcaccctgtctttgtctccaggggaaagagtcaccctctcctgcagggccagtcagagtgttgccagcagctacttagcgtggtaccagcagaaacctggccaggctcccaggctcctcatcgatggtgcatccagcagggccactggcatcccagacaggttcagtggcagtgggtctgggacagacttcactctcaccatcagcagactggagcctgaagattttgcagtgtattactgtcagcagtatggtagctcacctgccctcactttcggcggagggacaaaggtggagatcaaa

SEQ ID NO: 1645 - DNA, 357 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgttttactgtgcgaggatgggggtggcggactggtacttcgatctctggggccgtggcaccctggtcactgtctcctca

SEQ ID NO: 1646 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctatgctggtcatctatcaagatagcaagcggccctcagggatccctgaacgattctctggctccaactctgggaacacagccactctgaccatcagcgggacccaggctatggatgaggctgactattactgtcaggcgtgggacagcagcactggggtcttcggaactgggaccaaggtcaccgtccta

SEQ ID NO: 1647 - DNA, 387 bp, Homo sapiens
cagctgcagttgcaggagtcgggcccaggactggtgaagccttcggagaccctgtccctcacctgcactgtctctggtggctccatcagtaataataattattactggggctggatccgccagcccccagggaaggggctggagtggattgggagtatctcttatagtgggagcacgtattacagcccgtccctcaagagtcgagtctccatatcactcgacacgtccaagagccacttctccctgaccctgacctctgtgaccgccgcggacaccgccgagtattactgtgcgagagatagtggtagcagcagctggtccggggcttattattactactacggaatggacgtctggggccaagggaccacggtcaccgtctcctca

SEQ ID NO: 1648 - DNA, 321 bp, Homo sapiens
gacatccagatgacccagtctccttcctccctgtctgcatctgtgggagacagtgtcaccatcacttgccgggccagtcagagtattggtagctggttggcctggtatcagcagaaaccggggagagcccctaagctcctcatctataaggcctctagtttagatactggggtcccatcaaggttcagcggcagtggatctgggacagaattcactctcaccatcaacggcctgcagcccgatgactttgcaacttattactgccaccagtataatagttattctcggacgttcgcccaagggaccaaggtggaaatcaaa

SEQ ID NO: 1649 - DNA, 357 bp, Homo sapiens
gaggtgcagctggtggagtctgggggaggcttggtccagcctggggggtccctgagactctcctgtgcagcctctggattcacctttagtagctattggttgacctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagactatctagcagcagctggcactttgactactggggccagggaaccctggtcaccgtctcctca

SEQ ID NO: 1650 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatttcaagcggccctcagggatccctgagcgattctctggctccaactctgggaacacagccactctgaccatcagcgggacccaggctatggatgaggctgactattactgtcaggcgtgggacagcagcactggggtcttcggaactgggaccaaggtcaccgtccta

SEQ ID NO: 1651 - DNA, 357 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagtgggtagcagcagctggttctggaactactggggccagggaaccctggtcaccgtctcctca

SEQ ID NO: 1652 - DNA, 321 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactggaggagtgttcggcggagggaccaagctgaccgtccta

SEQ ID NO: 1653 - DNA, 369 bp, Homo sapiens
caggtgcagctgcaggagtcgggcccaggactggtgaagccttcggagaccctgtccctcacctgcattgtctctgatggttccgtcagcagtgggagttactactggagctggatccggcagcccccagggaagggactggagtggattggttatatctactatactgggagtaccaactacaacccctccctgaagagtcgagtcaccatatcagtagacaggtccaagagccagtactccctgaaggtgaggtctgtgaccgctgcggactcggccgtatattactgtgcgagagtctcgtggtatgactcggaccgctacactatggacgtctggggccaagggaccacggtcaccgtctcctca

SEQ ID NO: 1654 - DNA, 336 bp, Homo sapiens
gatattgtgatgactcagtctccactctccctgcccgtcacccctggagagccggcctccatctcctgcaggtctagtcagagcctcctgcatactaatggatacaactatttggattggtacctgcagaagccaggccagtctccacaactcctgatctatttgggttctaatcgggcctccggggtccctgacaggttcaggggcagtggatcaggcacagattttacactgaaaatcagcagagtggaggctgaggatgttggggtttattactgcatgcaatctcaacaaactccgtggacgttcggccaagggaccaaggtggaaatcaaa

SEQ ID NO: 1655 - DNA, 375 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagcctacgatattttgactggttattaactactgatgatgcttttgatatctggggccaagggacaatggtcaccgtctcttca

SEQ ID NO: 1656 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatccgctcactttcggcggagggaccaaggtggagatcaaa

SEQ ID NO: 1657 - DNA, 360 bp, Homo sapiens
gaggtgcagctggtggagtctgggggaggcttggtccagcctggggggtccctgagactctcctgtgcagcctctggattcacctttagtagttattggctgagctgggtccgccaggctccagggaaggggctggagtgggtggccaacataaagcaagatggaactgagaaatactatgtggactctgtgaagggccgactcaccatctccagagacaacgccaagaactcactgtatctccaaatgaacagcctgagagccgaggacacggctgtttattactgtgcgagagagcttataccagcagctggttcctttgactactggggccagggaaccctggtcaccgtctcctca

SEQ ID NO: 1658 - DNA, 318 bp, Homo sapiens
tcctctgaactgactcagccgccctcagtgtccgtgtccgcagggcagacagccagcatcacctgctctggagataaattggggaataaatatgtttcctggtatcagcagaggccaggccagtctcctttactggtcatctatcaagataggaaacggccctcagggatccctgagcgattctctggctccaactctgggaacacagccactctgaccatcagcgggacccaggttatggatgaggctgactattactgtcaggcgtgggacagcagcactgtggtattcggcggagggaccaagctgaccgtccta

SEQ ID NO: 1659 - DNA, 369 bp, Homo sapiens
caggtgcagctgcaggagtcgggcccaggactggtgaagccttcggagaccctgtccctcacctgcactgtctctggtggctccgtcagcagtggtagttactactggagctggatccggcagcccccagggaagggactggagtggattgggtatatctactatactgggagcaccaactacaacccctccctcaagagtcgagtcaccatatcagtagacaggtccaagaaccagttctccctgaagctgaggtctgtgaccgctgcggacacggccgtatattactgtgcgagagtctcgtggtatgacgcggaccgctacactatggacgtctggggccaagggaccacggtcaccgtctcctca

SEQ ID NO: 1660 - DNA, 336 bp, Homo sapiens
gaaattgtgatgactcagtcgccactctccctgcccgtcacccctggagagccggcctccatctcctgcaggtctagtcagagcctcctgcatactaatggatacaactatttggattggtacctgcagaagccagggcagtctccacagctcctgatctatttgggttctaatcgggcctccggggtccctgacaggttcaggggcagtggatcaggcacagattttacactgaaaatcagcagagtggaggctgaggatgttggggtttattactgcatgcaatctcaacaaactccgtggacgttcggccaagggaccaaggtggaaatcaaa

SEQ ID NO: 1661 - DNA, 375 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagggggattttggagtggttattataatactagggcgtgggcttttgatatctggggccaagggacaatggtcaccgtctcttca

SEQ ID NO: 1662 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtggacgttcggccaagggaccaaggtggaaatcaaa

SEQ ID NO: 1663 - DNA, 366 bp, Homo sapiens; identical to SEQ ID NO: 327

SEQ ID NO: 1664 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgacgttcggccaagggaccaaggtggaaatcaaa

SEQ ID NO: 1665 - DNA, 372 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgaggacacggccgtgtattactgtgcaacagatttctcgccccccctctatagcagctcgtccgggtttgactactggggccagggaaccctggtcaccgtctcctca

SEQ ID NO: 1666 - DNA, 324 bp, Homo sapiens
tcctatgtgctgactcagccaccctcagtgtcagtggccccaggaaagacggccaggattacctgtgggggaaacaacattggaagtaaaagtgtgcactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtagtagtgatcccgtggtattcggcggagggaccaagctgaccgtccta

SEQ ID NO: 1667 - DNA, 354 bp, Homo sapiens
caggtgcagctggtgcagtctggggctgaggtgaagaagcctggggcctcagtgaaggtctcctgcaaggcatctggatacacgtttaccagttactatatgcactggatacgacaggcccctggacaagggctcgaatggttggcaatgatcaaccctataggtggtttcacaaaatacgcacaaaaattccagggcagagtcaccgtgacccgggacacgtccacgagcacagtttacttggagatgagaagcctcagatctgaggacacagccctgtattactgtgcgagagaaacccagcagtggaccggggactactggggccagggatccctggtcatcgtctcctca

SEQ ID NO: 1668 - DNA, 330 bp, Homo sapiens
cagtctgccctgactcagcctccctccgtgtccgggtctcctgggcagtcagtcaccgtctcctgcactggaaccagcagtgacattggtagttataaccgtgtctcctggtaccggcagcccccaggcaccgcccccaaactcatcatttatgaggtcagtaatcggccctcaggggtccctgatcgcttctctgggtccaagtctggcaacacggcctccctgaccatctctgggctccaggctgaggacgaggctgattattactgcagctcatatacaagcagtagtactttgattttcggcggagggaccaagttgaccgtccta

SEQ ID NO: 1669 - DNA, 378 bp, Homo sapiens
gacgtaattttgttggagtctgggggaggcttagttcagcctggggggtccctgagactctcctgttcagcctctggattcccctttagcgaccacgtcatgagctgggtccgccagcctccagggaaggggctggagtgggtctcaattatttatagaagtggaactacatattattcaccctccgtgaagggccggttcaccatctccagagatgattccaagagcacgttgtatctgcaaatggacagcctgagagtcgacgacacggccatatatcgctgtgcgagatacttagtgccagtcccccaccgggcttattacttctactacgggatggacgtctggggccaagggaccacggtcaccgtctcctca

SEQ ID NO: 1670 - DNA, 336 bp, Homo sapiens
gagattgtgatgactcagtctccactctccctgcccgtcaccccaggagagccggcctccatctcctgcacgtctagtcagagtctcctgcatagtaatggatacaagtatttggattggtacgtgcagaagccagggcagtctccacagctcctgatctatttgggttctaatcgggcctccggggtccctgacaggttcagtggcagtggatcaggcacagattttacactgaaaatcagcagagtggaggctgaggatgttgggatttattactgcatgcacgctctccagattccgttcacttttggccaggggaccaagctggagatcaaa

SEQ ID NO: 1671 - DNA, 345 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagaggtccgtacggtgaaagtgtctggggccaagggaccacggtcaccgtctcctca

SEQ ID NO: 1672 - DNA, 321 bp, Homo sapiens; identical to SEQ ID NO: 6

SEQ ID NO: 1673 - DNA, 360 bp, Homo sapiens
gaggtgcagctgttggagtctgggggaggcttggtacagcctggagagtccctgagactctcctgtacatcttctggattcacctttagcaactatgtcatgagctgggtccgcctggctccacggaagggactggagtggctctcagtcatttataccggtagtagtggttcacagtatgccgactccgtgaagggccggttcaccatctccagagatgattccaagaatatgctgtatctgcaaatggacagcctgacagccgaggacacggccctatattactgcgcacggcgaggttcggggatttattataactttgactactggggccagggaatcctggtcaccgtctccaca

SEQ ID NO: 1674 - DNA, 321 bp, Homo sapiens
gccatccagatgacccagtctccatcccccctgtctgcatctgtcggagacagagtcaccatcacttgccgggcaagtcagggcattggaaatgatttaggctggtatcagcagaaaccagggaaagcccccaagctcctcatctatggtgcatccactttacaaagtggggtcccatcaaggttcagcggcagtggatctggcacagatttcactctcaccatcagcagcctgcagcctgaagattttgcaacttattactgtctacaagattacatttaccctctcactttcggccctgggaccaaagtggatatcaaa

SEQ ID NO: 1675 - DNA, 360 bp, Homo sapiens
caggtgcaactggtggagtctgggggaggcgtggtccagcctgggaggtccctgagactctcctgtgaagcctctgatttcatctttagaaactatcttatgcactgggtccgccaggctccaggcaaggggctggagtgggtggcacttatatcttttgatgggagtactacaaagttcgcagactccgtgaagggccgattctccgtctccagagacaattccaagaacacgttgtatttgcagctgaacagcctgagaagcgacgacacggctgtctattactgtgcgcgcgggggaagcagtggcaatgatgcctttgatatctggggccaaggcacattggtcaccgtctcttca

SEQ ID NO: 1676 - DNA, 336 bp, Homo sapiens
gatgttgtgatgactcagtctccactctccctgcccgtcacccttggacagccggcctccatctcctgcaggtctagtcaaagcctcgtatacagtgatggaaacatctacttcaattggtttcagcagaggccaggccaatctccaaggcgcctaatttataaggtttctaagcgggacgctggggtcccggacagattcagcggcagtgggtcaggcactgatttcacactgaaaatcagcagggtggaggctgaggatgttggaatttattactgcatgcaagctacacactggccgatcaccttcggccaagggacacgactggagattaaa

SEQ ID NO: 1677 - DNA, 348 bp, Homo sapiens
gaggtgcagctggtggagtctgggggcgtcttggtacagccaggggggtccctgagactctcctgtgcagcctcgggattctccttcagtagttacgacatgcactgggtccgccaaggcacgggaaaaggtctggagtgggtctcaggcattggcactgctggtgatagatattattcagactccgtgaagggccgatgcaccatctccagagacaatggcaagaactccttgtatcttcaattgaagagcctgagagccgcggacagggctgtgtattattgtgcaaggggggtgggtggaattatcgactactggggccagggaaccccggtcaccgtctcctca

SEQ ID NO: 1678 - DNA, 330 bp, Homo sapiens
aattttgtgctgactcagccccactctgtgtcggagtctccggggaagacggtaaccatctcctgcaccggcaacagtggcagcattgccaccaagtatgtacagtggttccagcagcgcccgggcagtgcccccaccactgtgatctatgaggataaccaaagaccctctggggtccctgatcggttctctggctccagcgacagctcctccaactctgcctctctcacgatctctggactgaagactgaagacgaggctgattactactgtcagtcttatcataacaggcgctgggtgtttggcggagggaccaggttgaccgtccta

SEQ ID NO: 1679 - DNA, 378 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagaacccgacgcgggggattggcagtggctgccccgaactggttcgacccctggggccagggaaccctggtcaccgtctcctca

SEQ ID NO: 1680 - DNA, 324 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattctccgctcactttcggcggagggaccaaggtggagatcaaa

SEQ ID NO: 1681 - DNA, 366 bp, Homo sapiens; identical to SEQ ID NO: 1325

SEQ ID NO: 1682 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctatcaccttcggccaagggacacgactggagattaaa

SEQ ID NO: 1683 - DNA, 354 bp, Homo sapiens
gaagtgcagttggtggaatctggaggaggcttgatccagccgggggggtccctgagactctcctgtgcaacctctgggttcaccgtcagtagcaacttcatgagttgggtccgccaggctccagggatgggcctggagtgggtctcaattatctatagcggtggtaaaacattctacgcggagtccgtgaggggccgattcaccatctctagagacaattccaagagcacgatatatcttcaaatgaacaacctgagagtcgaggacacggccgtctatttctgtgctcgaacaacagcagcagctggggactttgactactggggccagggcaccctggtcaccgtctcctca

SEQ ID NO: 1684 - DNA, 324 bp, Homo sapiens
tcgtctgagctgactcaggaccctgctgtgtctgtggccttgggacagacagtcaggatcacatgccaaggagccagcctctcaacttattatacaaactggtaccagcagaagccaggacaggcccctgtgcgtgtcatctatggtaaaaaccaccggccctcagggatcccagaccgattctctgcctccaggtcaggaaacacagcttccttgaccatcactggggctcaggcggaagatgaggctgactattactgtaactcctgggacaacagtggtgaccttccggtattcggcggagggaccaagcttaccgtccta

SEQ ID NO: 1685 - DNA, 357 bp, Homo sapiens
gaggtgcagctgttggagtctgggggaggcttggtacagcctggggggtccctgagactctcctgtgcagcctctggattcacctttagcatctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatctcggtgattcatacggtatggacgtctggggccaagggaccacggtcaccgtctcctca

SEQ ID NO: 1686 - DNA, 306 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgggagtggtattcggcggagggaccaagctgaccgtccta

SEQ ID NO: 1687 - DNA, 384 bp, Homo sapiens
caggttcagctggtgcagtctggagctgaggtgaagaagcctggggcctcagtgaaggtctcctgcaaggcttttgattacacctttcccacctatggtatcagctgggtgcgacaggcccctggacaagggcttgagtggatgggatggatcagcgtttacaatggtaacacaaactatgcacagaagttccagggcagagtcaccatgaccactgacacatccacgagcacagcgtacatggagctgaggagcctgagatctgacgacacggccgtgtattactgtgcgagagatccttggcagcatattgtagtcgtaccagctgctacgtcctacggtatggacgtctggggccaagggaccacggtcaccgtctcctca

SEQ ID NO: 1688 - DNA, 324 bp, Homo sapiens
gaaattgtgttgacacagtctccagccaccctgtctttgtctccaggggaaagagccaccttttcttgtagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactgggctccgagcaccttcggccaagggacacgactggagattaaa

SEQ ID NO: 1689 - DNA, 372 bp, Homo sapiens
gaagtgcaactagtggagtctgggggaggcttggtacagcctggcaggtccctgagactctcctgtgcagcctctggattcacctttaatgaatatgccatgtactgggtccgacaagctccagggaggggcctggagtgggtctcaggcattgattggaatagcggtcacataggctatgcggattctgttaagggccgattcaccatctccagagacaacaccaacaactccgtgtatctgcaaatggacagtctgagacctgaggacaccgccttgtattactgtgcaaaagataaggtcccctattacgacattttgactggttttttggactcatggggccagggaaccctgctcatcgtctcctca

SEQ ID NO: 1690 - DNA, 321 bp, Homo sapiens
gccatccagatgacccagtctccttccaccttgtctgcatctgtcggagacagagtcaccatcacttgccgggccagtcagagtattattacctggttggcctggtatcaacagaaaccagggaaagtccctaaactcctgatctataaggcggctagtttagaaagtggggtcccggccaggttcagcggcagtagatctgggacagaatacactctcaccatcaacagcctgcagcctgatgattttgcaagttattactgccaacagtataagacttacccgcacacttttggccaggggaccaagctggagatcaaa

SEQ ID NO: 1691 - DNA, 375 bp, Homo sapiens
caaatgcagctggtgcagtctgggcctgaggtgaagaagcctgggacctcagtgaaggtctcctgcaaggcttctggagtcacatttacaaattctgctgtgcagtgggtgcgacaggctcgtggacaggctcgtggacaacgccttgagtggataggatggatcgtcgttggcagtggtaaaacaaactacgcacagaagttccaggaaagagtcaccattaccagggacatgtccacaagaacagtctacatgaacctgagcagcctgagatccgacgacacggccgtctattattgtgcggcattttattggggcactggctggtactactttgactactggggccagggaaccctggtcaccgtctcctca

SEQ ID NO: 1692 - DNA, 324 bp, Homo sapiens
gaaatagtgatgacgcagtctccagccaccctgtctgtgtctccaggggaaagagccaccctctcctgcagggccagtcagcgtgttagcagcaacttagcctggtaccagcagaaacctggccaggctcccaggctgctcatctacggtgcatccaccagggccactggtatcccagccaggttcagtggcagtgggtctgggacagagttcactctcaccatcgacagcctgcagtctgaagattttgcagtttattactgtcagcagtataataactggcctccgctcactttcggcggagggaccatgctggagatcaaa

SEQ ID NO: 1693 - DNA, 369 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagttgtgctttctgtttgataagtggctggtaccactttgactactggggccagggaaccctggtcaccgtctcctca

SEQ ID NO: 1694 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctatcaccttcggccaagggacacgactggagattaaa

SEQ ID NO: 1695 - DNA, 360 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatcttttacagtgggagcacctactacaacccgtccctcaagagtcgagttaccatatcagtagacacgtctaagaaccacttctccctgaaggtgagctctgtgactgccgcggacacggccgtgtattactgtgcgagagatcccgccccccgtaaggggccagttatctggggccaagggacaatggtcaccgtctctgca

SEQ ID NO: 1696 - DNA, 330 bp, Homo sapiens
cagtctgccctgactcagcctgcctccgtgtctgggtctcctggacagtcgatcaccatctcctgcactggaaccaacagtgacattggttcttataactttgtctcctggtaccagcaacacccaggcaaagcccccaaacttatgatttatgaggtcagtaatcggccctcaggggtttctaatcgcttctctggctccaagtctggcagcacggcctccctgaccatctctgggctccaggctgaggacgaggctgattattactgcagctcatttacacgcagcaccactgtggtcttcggcggagggaccaagctgaccgtccta

SEQ ID NO: 1697 - DNA, 348 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaggctacgcacagaagttccagggcagaatcaccatgaccagggacacgtccacgagcacagtctacatggagctgagcagcctgagatctgaggacacggccgtgtattactgtgcgagagtgggcggtagtatggacgtctggggccaggggaccacggtcaccgtctcctca

SEQ ID NO: 1698 - DNA, 324 bp, Homo sapiens
gaaattgtgttgacgcagtctccaggcaccctgtctttgtctccaggggaaagagccaccctctcctgcagggccagtcagagtgttagcagcacctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgatcaccttcggccaagggacacgactggagattaaa

SEQ ID NO: 1699 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagcttggagtgggagctactacggtgcttttgatatctggggccaagggacaatggtcaccgtctcttca

SEQ ID NO: 1700 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctaggagtcttcggaactgggaccaaggtcaccgtccta

SEQ ID NO: 1701 - DNA, 384 bp, Homo sapiens; identical to SEQ ID NO: 443

SEQ ID NO: 1702 - DNA, 330 bp, Homo sapiens
cagtctgccctgactcagcctccctccgtgtccgggtctcctggacaatcagtcaccatctcctgcactggaaccagcagtgacgttggtagttatagccgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagctcaaatacaagcagcaccactttgatattcggcggagggaccaagctgaccgtccta

SEQ ID NO: 1703 - DNA, 384 bp, Homo sapiens; identical to SEQ ID NO: 241

SEQ ID NO: 1704 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctgcgctcactttcggcggagggaccaaggtggagatcaaa

SEQ ID NO: 1705 - DNA, 375 bp, Homo sapiens
cagattcaactggtgcaatctggagctgaggtgaagaagcctggggccgcagtgaaggtctcctgcaaggcttctggttacacctttaccagttatggtatctcctgggtgcgacaggcccctggacaagggcttgagtggatgggatggatcagcacttacaatggtaacacaaactatgcacagaacctccaggacagagtcaccatgaccacagacacatccacgagtacagcctacatggaactgaggagcctgagatctgacgacacggccgtatatttctgtgcgagagacaaggatgaaggggccaacagttggtacggggactggttcgacccctggggccagggaacccttgtcaccgtcgcctca

SEQ ID NO: 1706 - DNA, 330 bp, Homo sapiens
tcctatgagctgactcagccaccctcagtgtccgtgtccccaggacagacagccagcatcacctgctctggagataaattgggggataaatatgttggctggtatcagcagaagccaggccagtcccctgtgctggtcatctatcacgataacaagcggccctcagggatccctgagcgattctctggctccaactctggctccaactctgggaacacagccactctgaccgtcagcgggaccgaggctatggatgaggctgactatttctgtcaggcgtgggacagcagctctgtgttcttcggcggagggaccaagctgaccgtccta

SEQ ID NO: 1707 - DNA, 360 bp, Homo sapiens; identical to SEQ ID NO: 483

SEQ ID NO: 1708 - DNA, 339 bp, Homo sapiens
gacatcgtgatgacccagtctccagactccctggctgtgtctctgggcgagagggccaccatcaactgcaagtccagccagagtattttatccagctccaacaataggaactacttagcttggtaccagcagaaaccgggacagcctcctaagttgttcatttactgggcatctacccgggaagccggggtccctgaccgattcagtggcagcgggtctgggacagatttcagtctcaccatcagcagcctgcaggctgaagatgtggcagtttattactgtcagcaatattatgagaatgcgctcactttcggcggagggaccaaggtggagatcaaa

SEQ ID NO: 1709 - DNA, 375 bp, Homo sapiens
caggtgcagctggtggagtctgggggaggcgtggtccagcctgggaggtccctgagactctcctgtgcagcctctggattcattttccgaacctatgccatgcactgggtccgccaggctccaggcaagggactggaatgggtggcaagcatatcatatgatggggagatcaaatactatggagactccgtgaagggccgattcaccatctccagagacaattccaaggacacgctgtatctggaaatgaacagcctgagacctgaggacacggctatttattactgtccgaaagacgccccagggacttactatcatcgggggttcaactggttcgacccctggggccagggaaccctggtcactgtctcctca

SEQ ID NO: 1710 - DNA, 321 bp, Homo sapiens
gaaattgttttgacacagtctccagccaccctgtctttgtctccaggggaaagagtcaccctctcctgcagggccagtcagagtgttagtagctacatggcctggtaccagcagaaacctggccaggctcccaggctcctcctctatgatgcatccaacagggccactggcatcccagccaggttcagtggcagtgggtctgggacagacttcactctcagcatcagcagcctagagcctgaggattttgcagtttattactgtcagcagcgtagcagctggccgctcactttcggcggagggaccaaagtggagatcaaa

SEQ ID NO: 1711 - DNA, 363 bp, Homo sapiens
caggtgcagctggtggagtctgggggaggcgtggtccagcctgggaggtccctgagactctcctgtgcagcctctggattcaccttcagaagctatgctatccactgggtccgccaggctccaggcaaggggctggagtgggtggcagttatatcatttgatggaagtaataattactatgcagactccgtgaagggccgattcaccatctccagagacaattccaagaacacgctgtatctgcaaatgaacagcctgagagctgaggacacggctgtgtattactgtgcgaaagatcggtcggggaactactactacggtatggacgtctggggccaagggaccacggtcaccgtctcctca

SEQ ID NO: 1712 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcgaggttcagtggcagtggatctgggacagatttcactctcaccatcagcagtctgcaacctgaagattttgcaacttactattgtcaacagagttacagtaccctcggaactttcggccctgggaccaaagtggatatcaaa

SEQ ID NO: 1713 - DNA, 363 bp, Homo sapiens
caggtgcagctggtggagtctgggggaggcgtggtccagcctgggaggtccctgagactctcctgtgcagcctctggattcaccttcgcaacctatgctatgcactgggtccgccaggctccaggcaaggggctggagtgggtggcagttatatcacatgatggaagtaataaacattacgcagactccgtgaagggccgattcaccatctccagagacaattccaagaacacactgtatctgcaaatgaacagcctgagagctgagggcacggccatatattactgtgcgagagagagtttagaagcagctgcccccccctttgactactggggccagggaaccctggtcaccgtctcctca

SEQ ID NO: 1714 - DNA, 321 bp, Homo sapiens
tcctatgagttgactcagccaccctcagtgtccgtgtccccaggacagacagccaccatcacctgctctggagataaattgggggagaaatatgcttcctggtatcagcagaagccaggccagtcccctgcgctggtcatctatcaagataggaagcggccctcagggatccctgagcgattctctggctccaactctgggaacacagccactctgaccatcagcgggacccaggctatggatgaggctgactattactgtcaggcgtgggacagcagtaattctgtggtattcggcggagggaccaagctgaccgtccca

SEQ ID NO: 1715 - DNA, 345 bp, Homo sapiens
cagatcaccttgaaggagtcgggtcctacggtggtgaaacccacacagaccctcacgctgacctgctccttctctgggttctcactcagtatgggtggagtgggtgtccactggatccgtcagcccccaggaaaggccctggagtggcttgcactcattcattggaatgataaaaaggactacagcccatctctgaagcgcagactcagcatctccaaggacacgtccaaaaaccaggtggtccttacaatgactaacatggaccctgtggacacagccacatatttctgtgcacacaatatgggtgactactggggccagggaaccctggtcaccgtctcctca

SEQ ID NO: 1716 - DNA, 333 bp, Homo sapiens
cagtctgtgctgactcagccaccctcagcgtctgggacccccgggcagagggtcaccatctcttgttctggaagcaggtccaacatcggaactaacactgtaaactggtaccagcaactcccaggagcggcccccaaactcctcatctttagtaataatcttcggccctcaggggtccctgaccgattctctgcttccaagtctggcacctcagcctccctggccatcagtgggctccagtcggaggatgaggctgattattactgtgcagcgtgggatgacagtctgaatggcttttatgtcttcggaactgggacctgggtcaccgtccta

SEQ ID NO: 1717 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagccaccagggggagctactactggggtggggactactggggccagggaaccctggtcaccgtctcctca

SEQ ID NO: 1718 - DNA, 324 bp, Homo sapiens; identical to SEQ ID NO: 1492

SEQ ID NO: 1719 - DNA, 348 bp, Homo sapiens
caagtgcagctgcaggagtcggacccaggactggtgaagccttcggggaccctgtccctcacctgcgctgtctctggtggctccatcaccaatgataattggtggagttgggtccgccagtccccaggaaaggggctggaatggattgctgaaatctttcatagtgggagcgccaattacaacccgtccctcaagactcgggtgaccatatccatggacatgtccaggaaccagttttccctgaatatgaagtctctgaccgccgcggacacggccgtctattattgtgcgagaggtggatcttggttcccagtttggggcccgggaaccctggtcaccgtctcctca

SEQ ID NO: 1720 - DNA, 321 bp, Homo sapiens
gacacccagatgacccagtctccttccaccctgtctgcatctgtgggagacagagtcaccatcacttgccgggccagtcagaatattcataggtggttggcctggtatcagcagaaaccagggacagcccctaaggtcctgatctatgaggcgtctaatttacaaagtggggccccatcaagatttagcggcagtggatttgggacagaattcactctcaccatcagcagccttcagcctgatgattttgcaacttattactgccaacagtatcatggatatccgtggacgttcggccaagggaccaaggtggaagtcaaa

SEQ ID NO: 1721 - DNA, 351 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcagccctagtggtggtagcacaagctacgcacagaagttccagggcagagtcactatgaccagggacacgtccacgagcacagtctacatggagctgagcagcctgagatctgaggacacggccgtgtattactgtgcgagtgccatctactacggtatggacgtctggggccaagggaccacggtcaccgtctcctca

SEQ ID NO: 1722 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacatcacccaggcaaagcccccaaactcatgatttatgaggtcagtaatcggccctcagggatttctaatcgcttctctggctccaagtctggcaacacggcctccctgaccatctctgggctccaggctgaggacgaggctcattattactgcagctcatatacaagcagcagcaccccatatgtcttcggaactgggaccaaggtcaccgtccta

SEQ ID NO: 1723 - DNA, 384 bp, Homo sapiens
caggtgcagctgcaggagtcgggcccaggactggtgaagccttcggagaccctgtccctcacctgcactgtctctggtggctccattaccaccattagttactactggggctggatccggcagcccccagggaagggactggagtggattgggagtctctattttagtgggagtagctactataacccgtccctcaagagtcgaatcaccgtatcagtagacacgtccaagaaccacttctccctgaacctgagttctgtgaccgccgcggacacggccgtctattactgtggactcgtggagccgggatattacgattttcggactgattattcccccttctttgactcctggggccacggaattctggtcaccgtctcctca

SEQ ID NO: 1724 - DNA, 327 bp, Homo sapiens
gaaatagtgatgacgcagtctccagccaccctgtctgtgtctccaggggaaagagccaccctctcctgcagggccagtcagagtgttagcaacaacttagcctggtaccagcagaaacttggccaggctcccaggctcctcatctatggtgcatccaccagggccactggcatcccagtcaggttcagtggcagtgggtctgggacagagttcactctcaccatcagcagcctgcagtctgaagattttgcagtttattactgtcagcaatattatagctggcctcctttcctcactttcggcggaggaaccaaggtggagatcaaa

SEQ ID NO: 1725 - DNA, 369 bp, Homo sapiens
caggtgcagctgcaggagtcgggcccaggactggtgaagccttcggagaccctgtccctcatctgcactgtctctggtggctccatcagtggttaccactggaactggatccggcagccccccgggaagggactggagtggattgggtatatctattacactgggagcaccaactacaacccctccctcaagagtcgaatcaccatatcagtagacaagtccaagaaccagttctccctgaagctaagctctgtgaccgctgcggacacggccgtgtattactgtgcgagagaaatatacgatttttggagtggttatcaatacggtatggacgtctggggacaagggaccacggtcaccgtctcctca

SEQ ID NO: 1726 - DNA, 318 bp, Homo sapiens
gaaattgtgttgacacagtctccagccaccctgtctttgtctccaggggaaagagccaccctctcctgcagggccagtcagactgttagcaggtacttagcctggtaccaacagaaacctggccaggctcccaggctcctcatctatgatgcatccaacagggctcttggcatcccagccaggttcagtggcagtgggtctgggacagacttcactctcaccatcagctccctagagcctgaagattttgcagtttattactgtcagcagcgtaccaactggcctacgttcggccaagggaccaaggtggaaatcaaa

SEQ ID NO: 1727 - DNA, 366 bp, Homo sapiens
gaggcgcacttggcagagtctggaggagacctggtccagccgggggggtccctcagactgtcatgtgtagtctctggtttcaccgtcaacagctactacatgagttgggtccgccaggctccagggaaggggctggagtgggtctcaatcatttataacggtggtgagacattctacgaagactccgtgaagggccgattcaccatctccagagacaattccaagaacacgctgtttcttcaaatgcacagcctgagagtggaagacacggccgtttattattgtgcgagatcttctctggttgagggaatctatcaccaagctttagacgtctggggccaagggacaatggtcaccgtctcctca

SEQ ID NO: 1728 - DNA, 321 bp, Homo sapiens
gccatccggatgacccagtctccatcctcagtctctgcctctacaggagacagagtcaccatcacctgtcgggcgagtcaggatattagaagttatttagcctggtatcaacaaacaccagggaaagcccctaaactcctgatccatagtgcatccactttacaaagtgggatcccatcaaggttcagcggcagtggatctgggacagatttcactctcaccatcagccgcctgcagtctgaagattttgcaacttattactgtcaagaatatgaaagttatcctctctctttcggcggagggaccaaggtggagatcaaa

SEQ ID NO: 1729 - DNA, 381 bp, Homo sapiens
caggtacagctgcaggagtcgggcccaggactggtgaagccttcggggaccctgtccctcacttgcggtgtctcaggtgactctatcaccagtaaaaactggtggagttgggtccgccagccccgagggaagggactggagtggattggagatgtttatcatgttgggatggccgaatacaatccgtccctcaagagtcgagtcaccatgtcagtggacacgtccaagaatcaattctccctgaagctgacctctgtaaccgccgcggacacggccgtttattactgtgcgagaacattgggtttcgatttttggagtggttatccggagaggctcggtctggacgtctggggccaagggaccacggtcaccgtctcctca

SEQ ID NO: 1730 - DNA, 318 bp, Homo sapiens
gacatccagttgacccagtctccatccttcttgtctgcatctgcaggagacagagtcaccatcccttgccgggccagtcaggccattgtcaggtatttagcctggtatcagcaaaaaccagggaaagcccctaacctcctgatctatgctgcatccactttgcacagtggcgtcccatcaagatttagcggcagtggatctgggacagacttcactctcacaatcagcagtgtgcagcctgaagattctgcgacttattactgtcaacaacttaataattacgtgtcttttggccaggggaccaagctggagatcaga

SEQ ID NO: 1731 - DNA, 384 bp, Homo sapiens
caggtccaactggagcagtctggggctgaggtgaagaagcctgggtcctcggtgaaggtctcctgcacggctcctggagacaccttcaccacctatgccatctcctgggtgcgacaggcccctggacaagggcttgagtggatggggaggatcgtccctgtccttggtctgtcaaactacacacagacattgcagggcagagtcacgatcaccgccgacagatccacgaccacagcctacatggaactgaccagcctcagatctacagacacggccgtctactactgtgcgcgacatcgcattactgttattcagggacttcttatgcacactaacaactttttcgattcctggggccagggaaccctgatcaccgtctcctca

SEQ ID NO: 1732 - DNA, 324 bp, Homo sapiens
gaaataattatgacgcagtctccagccaccctgtctgtgtctccaggggaaagagccaccctctcctgcagggccagtcagagtgttggcagtaatttagcctggtaccagcagaaacctggccaggctcccaggctcctcatctatcgtgcatccaccagggccactggtgtcccagccaggttcagtggcagtgggtctgggacagagttcactctcaccatcagcagcctccagtctgaggattttgcagtttatttctgtcagcagtctactaattggcctccgatcactttcggccctgggaccaaagtggatttcaag

SEQ ID NO: 1733 - DNA, 366 bp, Homo sapiens
gaggtgcagctggtggagtctgggggaggcttggtccagcctggagggtccctgagactttcctgtgcagcctctggattcatcttcagtgaccactacatagactggatccgccaggctccagggaaggggctggagtgggtttgccgttctaggaacaaagctcacagttacaccacagaatacgccgcgtctgtgaaaggcagattcagcatctcaagagatgattcaaagaactcactgtatctgcaaatgaacagcctgaaaaccgaggacacggccgtgtattattgtgttagagcaggggattcaccccctgaaccttttcgtacctggggccaagggacaatggtcaccgtctcttca

SEQ ID NO: 1734 - DNA, 321 bp, Homo sapiens
gacatccagatgacccagtctccttccagcctgtctgcatctgttggagacagagtcaccattacttgccgggccagtcagagtattagtagctggttggcctggtatcagcagaaaccagggaaagcccctaaactcctgatctataaggcgtctactttagagattggggtcccatcaaggttcagcggcagtggatctgggacagaattcactctcaccatcagcagcctgcagcctgatgattttgcaacttattactgccaacattatcagagttatcccctcactttcggcggagggaccaacgtggagatcaaa

SEQ ID NO: 1735 - DNA, 363 bp, Homo sapiens
caggtgcagctccaggggtcgggcccaggactcgtgaggccttcacagaccctgtctctcacctgcactgtctctggtggctccatcaatagtggtggttactactggagctggatccgtcagcacccagggaagggcctggagtggattggatatatctattacagtgggagcacctactacagcccgtccctcaagagtcgactaaccatatcaatggacacgtctaagaaccagttctccctgaagctgagctctgtgactgccgcggacacggccgtatattactgtgcgagagacactggctacgatttgtatgcttttgatatgtggggccaagggacaatggtcaccgtctcttca

SEQ ID NO: 1736 - DNA, 333 bp, Homo sapiens
cagtctgtgctgactcagccaccctcagcgtctgggacccccgggcagagggtcaccatctcttgttctggaagcagctccaacatcggaagttattatgtatactggtaccaggagctcccaggaacggcccccaaactcctcatctataggaatgatcagcggccctcaggggtccctgaccgattctctggctccaagtctggcacctcagcctccctggccatcagtgggctccggtccgaggatgaggctgattattactgtgcagcatgggatgacagcctcagtggtttttatgtcttcgggactgggaccaaggtcaccgtccta

SEQ ID NO: 1737 - DNA, 402 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatggccattactatggttcagggagttattattacccattgcgcgattactactactactacggtatggacgtctggggccaagggaccacggtcaccgtctcctca

SEQ ID NO: 1738 - DNA, 327 bp, Homo sapiens
tcgtctgagctgactcaggaccctgctgtgtctgtggccttgggacagacagtcaggatcacatgccaaggagacagcctcagaagctattatgcaagctggtaccagcagaagccaggacaggcccctgtacgtgtcatctatggtaaaaacaaccggccctcagggatcccagaccgattctctggctccagctcaggaaacacagcttccttgaccatcactggggctcaggcggaagatgaggctgactattactgtaactcctgggacagcagtggtaaccatcatgtggtattcggcggagggaccaagctgaccgtccta

SEQ ID NO: 1739 - DNA, 375 bp, Homo sapiens
gaagtgcagttggtggaatctgggggaggcttggtacagcctggcaggtccctgagactctcctgtgcagcctctggattcacctttgatgattatgccatgcactgggtccggcaaggtccagggaagggcctggagtgggtctcaggtattagttggaatagtggtagcataggctatgcggactctgtgcagggccgattcaccatctccagagacaacgccaagaactccctgtatctggaaatgaacagtctgagagctgaggacacggccttgtattactgtgcaaaagatgtagtctataagggatacacctatgggcagggatactctgactactggggccagggaaccctggtcaccgtctcctca

SEQ ID NO: 1740 - DNA, 324 bp, Homo sapiens
gacatccagatgacccagtctccatcctccctgtctgcatctgtaggagacagagtcaccatcacttgccggccaagtcagagcattagcagctatttaaattggtatcaacagaaaccagggaaagcccctaagctcctgatctatgctgcatccaatttgcgaagtggggtcccatcaaggttcagtggcagtgaatctgggccagatttcactctcaccatcagcagtctgcaacctgaagattttgcaacttactactgtcaacagacttacagtattcctccgatcaccttcggccaggggacacgactggacattaaa

SEQ ID NO: 1741 - DNA, 378 bp, Homo sapiens
caggttcagctggtgcagtctggagctgaggtgaagaagcctggggcctcagtgaaggtctcctgcaaggcttctggttacacctttaccaactttggtatcagctgggtgcgacaggcccctggacaagggcttgagtggatgggatggatcagctcttacaatggaaacacaaactatgaacagaagctccagggcagagtcaccatgaccacagacacatccacgagcacagcctacatggagctgaggagcctgagatctgacgacacggccgtgtattactgtgcgagagtcccccctaccacctactattatacttcggggagttactactgtgaccactggggccagggaaccctggtcaccgtctcctca

SEQ ID NO: 1742 - DNA, 321 bp, Homo sapiens
gacatccagatgacccagtctccatcctccctgtctgcatctgtaggagacagagtcaccatcacttgccgggcaagtcagagcattagcagctatttaaattggtatcaccagaaaccagggagagcccctaagctcctactctatgctgcatccactttgcacagtggggtcccatcaaggttcagtggcagtggatctgggacagatttcactctcaccatcagcagtctgcaacctgaagattttgcaacttactactgtcaacagagttacagtacccctcagacttttggccaggggaccaagctggagatcaaa

SEQ ID NO: 1743 - DNA, 363 bp, Homo sapiens
caggtgcagctggtggagtctgggggaggcgtggtccagcctgggaggtccctgagactctcctgtgcagcctctggattcaccttcgcaacctatgctatgcactgggtccgccaggctccaggcaaggggctggagtgggtggcacttatatcacatgatggaagtaataaacattacgcagactccgtgaagggccgattcaccatctccagagacaattccaagaacacactgtatctgcaaatgaacagcctgagagctgagggcacggccatatattactgtgcgagagagagtttagaagcagctgcccccccctttgactactggggccagggaaccctggtcaccgtctcctca

SEQ ID NO: 1744 - DNA, 321 bp, Homo sapiens; identical to SEQ ID NO: 402

SEQ ID NO: 1745 - DNA, 357 bp, Homo sapiens
gaggtgcagttggtggagtctgggggaggcttgaaacagccgggggggtccctgagactctcctgtgtagcctctggattcacctttagcaactgtgccatgagctgggtccgccaggctccagggaaggggctggagtgggtctcacttatttatgccgctgggacgagtacttattatgcagactccgtgaagggccgattcaccatctccagagataatttcaagaacacactgtatctacaaatgaacagtctcagagccgaggacacggccatatattactgtgcgaaagggcatatcagcaactggtaccttgacaactggggccagggagtcctggtcaccgtctcctca

SEQ ID NO: 1746 - DNA, 324 bp, Homo sapiens
caaatagtgatgacgcagtctccagccaccctgtctgtgtctctaggggaaagagtcaccctctcctgcagggccagtcagagtgttggcagcaacttagcctggtaccagcagaaacctggccaggctcccaggctcctcatctatggtgaatctaccagggccactggtgtcccagccaggttcagtggcagtgggtctgggacagacttcactctcaccatcagcagcctgcagtctgaagattttgctgtttattactgtcagcagtataatcagtggcctccgtgcacttttggccaggggaccaagctggagatcaaa

SEQ ID NO: 1747 - DNA, 378 bp, Homo sapiens
caggtgcagctggtgcagtctggggctgaagtgaagaagcctgaggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtgcgagaggccgatattgtactggtggtgtatgctggggggactggtacttcgatctctggggccgtggcaccctggtcactgtctcctca

SEQ ID NO: 1748 - DNA, 324 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatacttattctccgtggacgttcggccaagggaccaaggtggaaatcaaa

SEQ ID NO: 1749 - DNA, 378 bp, Homo sapiens
cagctgcagctgcaggagtcgggcccaggactggtgaagccttcggagaccctgtccctcacctgctctgtctctggtggctccatcatcagcagtagttactactggggctggatccgccagcccccagggaaggggctggagtggattgggagtgtctttcatagtgggaccacctactacaacccgccccgcaagagtcgagtcaccatatccgtcgacacgtccaagaaccagttctccctgaagctgacctctgtgaccgccgcagacacggctgtgtattattgtgtgagacaaagtagaggatcctactatgatggtaataattaccaaatcttagactggggccagggaaccctggtcatcgtctcctca

SEQ ID NO: 1750 - DNA, 339 bp, Homo sapiens
gatattgtgatgactcagtctccactctccctgcccgtcacccctggagagccggcctccatctcctgcaggtctagtcagagcctcctgcatagtgatggaaacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggcatctattactgcatgcaagctctacaaactcctgcgctcactttcggcggagggaccaaggtggagatcaaa

SEQ ID NO: 1751 - DNA, 393 bp, Homo sapiens
caggtgcaactacaggagtcgggcccaggactggtgaagccttcacagaccctgtccctcacctgcactgtctcgggtgtctccatcaatagtggtctctattattggagctggatccgacagcccgccgggaagggactggagtggattgggcgtatctttagcgatggcccttcctatgacactgggaccaccagctataacccctccctcaaaaatcgagccaccatatcactggacacgtccaggaatcagttctccctgagactgagcgctgtgaccgccgcagacacggccgtgtattactgtgcgatcttgccggacgtttgggggaaccagggggttgacaatattcatccctggggccaagggactatggtcaccgtctcctca

SEQ ID NO: 1752 - DNA, 321 bp, Homo sapiens
gacatccagatgacccagtctccatcctccctgtctgcctctgtaggagacagagtcaccatcacttgccaggcgagtcaggacattaacaactatttaacttggtatcaacagaaaccaggcaaagcccctaaactcctgatctacgatgcatccaatttggagacaggggtcccttcaaggttcagtggaactagatctgggacagattttagtttcatcatcagcagcctgcagcctgaagatgtcgcaacatattactgtcaacaatatgataatctcccgtacacttttggccaggggaccaagctggagatcaaa

SEQ ID NO: 1753 - DNA, 366 bp, Homo sapiens
caggtgcacctggtgcagtctggggctgaggtgaagaaggctggggcctcagtgaaggtctcctgcaaggcttctggatacactttcaccgcctactatatccactgggtgcgacaggcccctggacaagggcttgagtggatgggatggatcaaccctagcactggaggcacagactatgcacagaactttcagggcaggttcaccgtggccagggacacgtccatcagcacagtatacatggagctgagtggtctgagatctgacgacacggccatctattactgtacgaaagagggccagcggcactacattggttcctggttcgacccctggggccagggaaccctggtcaccgtctcctca

SEQ ID NO: 1754 - DNA, 330 bp, Homo sapiens
caatctgtgttgacgcagccgccctcggtgtctgcggccccaggacagaaggtcaccatctcctgctctggaagcagctccaacattgggaatgagtatgtatcctggtaccagcagctcccaggaacagcccccaaagtcctcatttatgacaataataagcgaccctcagggattcctgaccgattctctgcctccaagtctggcacgtcagccaccctgggcatctccggactccagactggggacgaggccgattactactgcggaacatgggataccagcctgactgcttatgtcttcggaactgggaccaaggtcaccgtccta

SEQ ID NO: 1755 - DNA, 378 bp, Homo sapiens
caggtgcagctggtggagtctgggggaggcttggtcaagcctggagggtccctgacactcgcctgtgcagcctctggattcagcttcagtgaatactacatgacgtggatccgccaggctccagggaaggggccggagtgggttgtacacatcagttctgggggtgataatgttcactatgcagactctgtgacgggccgattcaccatctctagggacaacgcccagaactcattgtctctgcaaatgaccagcctgagagccgacgactccgccgtttattactgtgcgagaggagggcggcgggacctcgcactgggtccttattattatgctctggacctctggggccaagggaccacggtcaccgtctcctca

SEQ ID NO: 1756 - DNA, 324 bp, Homo sapiens
gaaatagtgatgacgcagtctccagccaccctgtctgtgtctccaggggaaagagccaccctctcctgcagggccagtcagagtattagtaacaacattgcctggtaccagcagaagcctggccaggctcccaggctcctcatctatggtgcatccaccagggccactggtgtcccagccaggttcagtggcggtgggtctgggacagagttcactctcaccatcagcagcctgcagtctgaagattttgcagtttattactgtcagcagtataatgactggccgccgatcaccttcggccaagggacacgactggagattaaa

SEQ ID NO: 1757 - DNA, 372 bp, Homo sapiens
gaggcgccactggttgagtctgggggaggcttggtaaagccagggcggtccctgagactcacctgtagaacttctggattcaccttccgtgactttactatcagttggttccgtcaggctccagggaagggcctggagtgggtcggtttcattagagacccctcttatggtgggacaacagactacgccgcgtctatgagagacagattcaccatctcaagagatgactccaaaagtatcgcctatctgcaaatggacagcctgaagaccgaggacacagccgtctatttctgtgccaagaggatcggctatggttcgggtatttatgtctttgatcaatggggccagggaaccctggtcaccgtctcctca

SEQ ID NO: 1758 - DNA, 318 bp, Homo sapiens
gagatagtgatgacgcagtctccagccaccctgtctgtgtctccaggggacagagccaccctctcctgcagggccagtcagagtgttagcagcgacttagcctggtaccagcagaaacctggccaggctcccagactcctcatctatggtgcatctaccagggccactggtatcccagccaggttcagtggcagtgggtctgggacagaattcactctcaccatcagcagcctacagtctgaagatattgcagtttattactgtcaacagtatgatgactggctctctttcggcggagggacaaaggtggagatcaaa

SEQ ID NO: 1759 - DNA, 360 bp, Homo sapiens
caggttcaattggtccagtctggaggtgagatgaagaagccaggggcctcagtgaaggtctcctgtaagacttctggttataacttcaattcctatggagtcagctgggtgcgacaggcccctggacaaggacttgagtggataggttggatcaatgcttacaaaggagacataaattacggagaggggttccagggtcgagtcgccctgaccgcagatgcattagcgaccacagtttatatggagttgaggagtctaagacctgacgacacggccgtttattactgtgcgcgagacttcgggtacaatggctacgactttgacttctggggccagggaacgttggtcaccgtctcctca

SEQ ID NO: 1760 - DNA, 330 bp, Homo sapiens
attgttaagcttactcagccccactctgtgtcggagtctccggggaagacggttgccatctcctgcaccgccagcgatggcagcattgacagcaagtttgtgcagtggctccagcagcgcccgggcagtgcccccaagattgtgatttttgaagatgaccaaagaccctctggggtccctgagcgattttctgcctccatcgacaggtcctccaactctgccaccctcatcatctctggactgaggaccgacgacgaggctgactactattgtcagtcttatgatggcagtagtcgggtgttcggcggagggaccaagctgaccgtcctg

SEQ ID NO: 1761 - DNA, 372 bp, Homo sapiens; identical to SEQ ID NO: 11

SEQ ID NO: 1762 - DNA, 321 bp, Homo sapiens
gacatccagatgacccagtctccatcctccctgtctgcatctgtaggagacagagtcaccatcacgtgccaggcgagtcaggacattagcaactatttaaattggtatcaacagaaaccaggaaaagcccctaacctcctgatcaacgctgcatccaatttgaaaacaggggtcccatcaaggttcagtggaagtggatctgggacatattttactttcaccatcagcagcctgcagcctgaagatattgcaacctattactgtcagcaatatgataatctccctctcactttcggcggagggaccaaggtggagatcaaa

SEQ ID NO: 1763 - DNA, 348 bp, Homo sapiens
gaggtgcggctgttggagtcggggggagacttggtgcagccgggggggtccctgagactctcctgtgttgcctctgggttcacctttagaggctatgccatgacatgggtccgccaggcgccggggaaggggcttgagtggctcgccgctatctatagtggtggtgatggcccagagtctgcagactccgtgaagggccgcttcatcatctctagagataactccaagaacacactgtatctgcaaatgaacagtctgagcgtcgaggacacgggcgtctattattgtgcgaaaagcagtggggcatttgactcctggggccagggaactcgggtcatcgtcacctca

SEQ ID NO: 1764 - DNA, 321 bp, Homo sapiens
gacatccagctgacccagtctccttccaccctgtctgcatctgtaggagacagggtcaccatcacttgccgggccagtcagaatattaatagttggttggcctggtataggcagaaaccaggggaagcccctcaactcctgatctacaaggcgtccactttagaacgtggggtcccttcaaggttcagcggcggcgggtcagggacagaattcactctcaccatcagcagcctgcagcctgaggattttgcaagttttcactgccaacagtattctagttacccgtacagttttggccaggggacgaagctccatctggat

SEQ ID NO: 1765 - DNA, 402 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagaaaccgggaggggatttacgatttttggagtggttaccatcgtctctcctactactactactacggtatggacgtctggggccaagggaccacggtcaccgtctcctca

SEQ ID NO: 1766 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaa

SEQ ID NO: 1767 - DNA, 357 bp, Homo sapiens
caggtgcagctggtggagtctgggggaggcctggtcaagcctggagggtccctgagactctcctgtgcagcctctaaattcaccttcagtgactattacatgagctggctccgccaggctccagggaagggcctggagtggatttcatacattagtggtagtagtggtgacatatactacgcagactctgtgaagggccgattcaccatctccagggacaacgtcaggaatgtactgtatctgcaaatgaacagcctgagagtcgaggacacggccgtttatttctgtgcgaggctccgtagggccccatggaactttgactactggggccagggaaccctggtcaccgtctcctca

SEQ ID NO: 1768 - DNA, 330 bp, Homo sapiens
cagtctgtgctgactcagccaccctcagcgtctgggacccccgggcagacggtcaccatctcttgttctggaagcagctccaacatcggaattcagactgtaaactggtaccagcagctcccaggaacggcccccaaactcctcgtctatagtaatgatcagcggccctcaggggtccctgaccgattctctggttccaagtctggcacctcagcctccctggccatcagtgggctccagtctgaagatgaggctgattattactgtgcagcatgggatgtcagcctgaatggtccaatcttcggcggagggaccaagctgaccgtccta

SEQ ID NO: 1769 - DNA, 363 bp, Homo sapiens; identical to SEQ ID NO: 463

SEQ ID NO: 1770 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttatgtggtattcggcggagggaccaagctgaccgtccta

SEQ ID NO: 1771 - DNA, 384 bp, Homo sapiens; identical to SEQ ID NO: 89

SEQ ID NO: 1772 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcaccccttatgtcttcggaactgggaccaaggtcaccgtccta

SEQ ID NO: 1773 - DNA, 405 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacaccgggtataacgacgagtggggttctctctcattttatttgggggctacgatccaaccaaactactttgactactggggccagggaaccctggtcaccgtctcctca

SEQ ID NO: 1774 - DNA, 333 bp, Homo sapiens; identical to SEQ ID NO: 436

SEQ ID NO: 1775 - DNA, 363 bp, Homo sapiens
caggtgcacgtggtgcagtctggggctgaggtgaaaaagcctggggcctcagtgaaggtctcctgcaagacctctggatacaccttcaccggctactatatacactgggtgcgacaggcccctggacaagggcttgagtggatgggatggatgaatcctaaaagtggtggcacagattatgcacagaagtttcagggcagggtcactttgaccagggacacctccaccagcacagtctccttggagctgaccagactgagatctgacgacacggccgtctatttctgtgcaagaggagcgacgattggttttcatgatccttttgatgtgtggggccaagggacactggtcaccgtctcttca

SEQ ID NO: 1776 - DNA, 315 bp, Homo sapiens
gacatccagatgacccagtctccttccaccctgtctgcttctgtaggagacagagtcaccatcacttgccgggccagtcagagtattaataggtggttggcctggtatcagcagaaaccagggaaagtcccaaagctcctgatctataaggtgtctactttacaaagtggggtcccatcaaggttcagcggcagtggatctgggacagaattcactctcaccatcagcagcctgcagcctgatgacttcgcaacttattactgccaacaatataatagtttttcattcggccaagggaccagggtggaaatcaaa

SEQ ID NO: 1777 - DNA, 351 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcacttatatcatatgatggaagcaataaatactacgcagactccgtgaagggccgattcaccatctccagagacaattccaagaacacgctgtatctgcaaatgaacagcctgagagctgaggacacggctttttattactgtgcgagagatacaggtggctacgccgactactggggccagggaaccctggtcaccgtctcctca

SEQ ID NO: 1778 - DNA, 318 bp, Homo sapiens
tcctatgaggtgactcagccaccctcagtgtccgtgtccccaggacagacagccagcatcacctgctctggagataaattgggggataaatatgcttgctggtatcagcagaagccaggccagtcccctgtgctggtcatgtatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 1779 - DNA, 360 bp, Homo sapiens
caggtgcagctggtggagtctgggggaggcgtggtccagcctgggaggtccctgagactctcctgtgaagcgtctggaatcaccttcagtagctataacatgcactgggtccgccaggctccaggcaaggggctggagtgggtggcacttatatggtatgatggaagtgataaatattatgcagactccgtgaagggccgattcaccatctccagagacaattccaagaacacactgtatctgcaaatgaacagcctgagagtcgaggacacggctatcttttactgtgcggcggcaccctgggatgatactagtggatatgactactggggccagggaaccctggtcaccgtctcctca

SEQ ID NO: 1780 - DNA, 327 bp, Homo sapiens
gaaattgtgctgacgcagtctccaggaattctgtctgtgtctccaggggaaagagccaccctctcctgcagggccagtcagagtgttagcaacacctacttagcctggtaccagcagaaacctggccaggctcccaggctcctcatctatgctgcaaccaacagggcccctggcatcccagacaggttcagtggcagtgggtctgggacagacttcactctcaccatcagcagactggagcctgaagattttgcaacgtattactgtcagaagtatggtaactcacctccgatcactttcggccctgggaccaaggtggatatcaaa

SEQ ID NO: 1781 - DNA, 378 bp, Homo sapiens
gaggtgcagctggtggactccgggggaggcttggtccagccgggagggtccctgaaactctcctgtgcagcctctgggctcaacgtcagtggctctgctatgcactgggtccgccagacttccgggaaagggctggagtgggttggccgtattagaagcaaaattggcagttatgcgacagcatatgctgcgtcggtaagaggcaggttcaccatttccagagatgattcaaaaaacacggcctatctgcaaatgaatggcctgaaaaccgaagacacggccgtgtattactgttctagtcggactatttaccctagcggtggccgctacgcggttgtggaatactggggccagggaaccctggtcaccgtctcttca

SEQ ID NO: 1782 - DNA, 330 bp, Homo sapiens
gaaattgtgttggcgcagtctccaggcaccctgcctttgtctccaggggacagagtcaccctctcctgcagggccagtcagagtgttagcagcaactacttagcctggtatcagcaaaaacctggccaggctcccaggctcctcatctatgctgcatccagcagggcccctggcgtcccagacaggttcagtggcagtgggtctgggacagacttcactctcaccatcagcagactggagcctcaggattttgcaatgtattactgtcaccactatggtagctcacctccggcgtacacttttggccaggggaccaagctggagatcaaa

SEQ ID NO: 1783 - DNA, 378 bp, Homo sapiens
caggtccagcttgtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggggggcagctggtacggctcactctttactactactacggtatggacgtctggggccaagggaccacggtcaccgtctcctca

SEQ ID NO: 1784 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctgctacgttcggccaagggaccaaggtggaaatcaaa

SEQ ID NO: 1785 - DNA, 363 bp, Homo sapiens
caggttcagctggtgcagtctggagctgaggtgaagaagcctggggcctcagtgaaggtctcctgcaaggcttctggttacaccttttccagctatggtatcagctgggtgcgacaggcccctggacaagggcttgagtggatgggatggatcagcgcttacaatggtgacacaaactatgcacagaagctccagggcagagtcaccatgaccacagacacatccacgagcacagcctacatggagctgaggagcctgagatttgacgacacggctgtgtattactgtgcgagagataaatattactatgatagtagtggttatggggcctggggccaagggacaatggtcaccgtctcttca

SEQ ID NO: 1786 - DNA, 321 bp, Homo sapiens
gacatccagatgacccagtctccatcttccgtgtctgcatctgtaggagacagagtcaccatctcttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgctacttactattgtcaacaggctaacagtttccctcggacgttcggccaagggaccaaggtggaaatcaaa

SEQ ID NO: 1787 - DNA, 366 bp, Homo sapiens
gaagtgcagctggtggagtctgggggaggcttggtacagcctggcaggtccctgagactctcctgtgcagcctctggattcaactttcatgattatgccatgcactgggtccggcaagatccagggaagggcctggagtgggtctcaggtattaattggaatagtggtgagatagtctatgcggactctgtgaagggccgattcaccatctccagagacaacgccaagaactccctgtttctgcaaatgaaccgtctgaaaactgaagacacggccttctattactgtgctaaagatagtgtggttcggggagtctatgattcttttgatttctggggccaagggacaatggtcaccgtctcttca

SEQ ID NO: 1788 - DNA, 321 bp, Homo sapiens; identical to SEQ ID NO: 1620

SEQ ID NO: 1789 - DNA, 411 bp, Homo sapiens
cagctgcagctgcaggagtcgggcccaggactggtgaacccttcggagaccctgtctctcacatgcactgtctctggtggctccatcagtagtaggagttcctactggggctggggctggatccgccagcccccagggaagggactggagtggattgggaatatctattatactgggagcacctacgacaacccgtccctcaagagtcgagtcaccatatcagtagacacgtccaagaaccaattctccctgcagctgagttctctgaccgccgcggacacggccgtgtattattgtgcgagactaattgtagtggaggaagctgcggaggtggtagctgctatgggaggtgttttaccgccgttagggttcgacccctggggccagggaaccctggtcaccgtctcctca

SEQ ID NO: 1790 - DNA, 333 bp, Homo sapiens
cagtctgccctgactcagcctgcctccgtgtctgggtctcctggacagtcgatcaccatctcctgcaccggaaccagcactgatgttgggacttataaccttgtctcctggtaccaacagtacccaggcaaagcccccaaactcataatttatgagggcagtaagcggccctcaggggtttctaatcgcttctctggctccaagtctggcaacacggcctccctgacaatctctgggctccaggctgaggacgaggctgattattactgctgctcatatgcaggtagtactactttcgtggtattcggcggagggaccaagctgaccgtccta

SEQ ID NO: 1791 - DNA, 384 bp, Homo sapiens
gaggcgcaactggtggagtctgggggagccttggtacagcctggggggtccctgagactctcctgtggagcctcaggattcaccttcagtcgctatagcttcaactgggtccgccaggctccagggaaggggctggagtgggttgcctacattagtaggagtgcgacctccacatactacgcagactctgtgaggggccgattcaccatctccagagacaacgccaagaggtcactgtatctgcaaatgaacagcctgacagccgaggacacggctatttattactgtgcgcgagaccgcattactatgcttcagggagctactgaaagggggggggacggtctggacgtctggggcccagggaccacggtcaccgtctcctca

SEQ ID NO: 1792 - DNA, 330 bp, Homo sapiens
cagtctgtgctgactcagccaccctcggtgtctgcagccccccggcagagggtcaccatctcctgttctggaagcagctccaatatcggacataatgctgtacactggtaccagcaactcccagggaaggctcccaaacttctcatctattatgatgatctactgccctcaggggtctctgaccgattcgctggctccaagtctggcacctcagcctccctggccatcagtggcctccagtctgaggatgaggctcagtattactgtgcaacatgggatgacgggctgaatgctgtggtattcggcggagggaccaagctgaccgtccta

SEQ ID NO: 1793 - DNA, 381 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagatccggcctcttacgatttttggagtggttattctgggggtatgtttgactactggggccagggaaccctggtcaccgtctcctca

SEQ ID NO: 1794 - DNA, 327 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcctatgtacacttttggccaggggaccaagctggagatcaaa

SEQ ID NO: 1795 - DNA, 363 bp, Homo sapiens
cagctgcagctgcaggagtcgggcccaggactggtgaagccttcggagaccctgtccctcacctgcactgtctctggtggctccgtcaccagtgtaaatttctactggggctggatccgccagtcccccgggaagggactggagtggattgcgagtatctattctagtgggagcacctactacaacccgtccctcaagagtcgagtcaccatctcattagacacgtccaagaaccggttctccctgaagctgaattctgtgaccgccgcggacacggccgtgtattactgtgcgagagcccgaggtggcagccgaggcctctttgactactggggccagggaaccctggtcaccgtctcctca

SEQ ID NO: 1796 - DNA, 321 bp, Homo sapiens
gacatccagatgacccagtctccttccaccctgtctgcatctgtaggagacagagtcaccatcacttgccgggccagtcagagtattagtttctggttggcctggtatcagcagaaaccagggaaagcccctcagctcctgatctataaggcgtctactttagaaactggggtcccatcaaggttcagcggcagtggatctgggacagaattcactctcaccatcagcagcctgcagcctgatgattttgcatcttattactgccaacagtataatagttattctgggacgttcggccaagggaccaaggtggaaatcaaa

SEQ ID NO: 1797 - DNA, 369 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagagggatacagctatggcatggttggggggtacttcgatctctggggccgtggcaccctggtcactgtctcctca

SEQ ID NO: 1798 - DNA, 327 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcatcgtattcggcggagggaccaagctgaccgtccta

SEQ ID NO: 1799 - DNA, 384 bp, Homo sapiens
gaggtccaactggtacagtctggggctgaagtgaagaagcctggggctacagtgaaaatctcctgtaaggtttctggatacaccttcaccgactacttcttgcactggattcaacaggcccctggaaaagggcttgagtggatgggacttcttgatcctgaagatggtgaaacactgtatgcagagaagttccggggaagcgtcaccatgaccgcggacacgtctacggacacagcctacctgcaactgagtagcctcacatctgaggacacggccgtgtattactgtgcaacactcatagtcccaggctttagcagtggctggcacaatcggggctacttctttgaccagtggggccagggaaccctggtcacggtctcctca

SEQ ID NO: 1800 - DNA, 318 bp, Homo sapiens
gaaatagtgatgacgcagtctccagtcaccctgtctgtgtctccaggggaaagagccaccctctcctgcagggccagtgagagtgtgagtagcaagttagcctggtaccagcagaaacctggccagcctcccaggctcctcatctatggtgcttccaccagggccactggaatcccacccaggttcagtggcagtgggtctgggagagagttcactctcaccatcaccggcctgcagtctgaagattttgcagtttattactgtcagccgtatgatgactggcccctcttcggccaagggacacgactggacattaag

SEQ ID NO: 1801 - DNA, 369 bp, Homo sapiens
gaagtgcagctggtggagtctgggggaggcttggtacagcctggcaggtccctgagactctcctgtgcagcctctggattcacctttgatagttattccatacactgggtccggctggctccagggaagggcctggagtgggtctcaggtattagttggaatagtggtaacatagtctatgcggactctgtgaagggccgattcaccatctccagagacaacgccaagaactccctgtatctgcaaatgaacagtctgagagctgaggacacggccttgtattactgtgcaaaagcccagacatcgtataccagctcgtcacgcgcttttgatatctggggccaagggacaatggtcaccgtctcttca

SEQ ID NO: 1802 - DNA, 324 bp, Homo sapiens
cagtctgccctgactcagcctgcctccgtgtctgggtctcctggacagtcgatcaccatctcctgcactggaaccagcagtgacattggtacttataactatgtctcctggtaccaacagcacccaggcaaagcccccaaactcatgatttatgaggtcagtaatcggccctcaggggtttctaatcgcttctctggctccaagtctggcaacacggcctccctgaccatctccggcctccaggctgaggacgagggtgattattactgcagctcatatacaagcacttatgtcttcggaactgggaccaaggtcaccgtccta

SEQ ID NO: 1803 - DNA, 348 bp, Homo sapiens
gaggtgcagctggtggagtctgggggaggtttggtccagcctggggggtccctgagactctcctgtgcagcctctggattcacccttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagtcgacgacacggctgtgtattactgtgcgtttacgtcaacagcccctaggtactggggccagggaaccctggtcaccgtctcctca

SEQ ID NO: 1804 - DNA, 339 bp, Homo sapiens
gacatcgtgatgacccagtctccagactccctggctgtgtctctgggcgagagggccaccatcaactgcaagtccagccagagtgttttatacggctccaacagtaagaactacttagcttggtaccagcagaaaccaggacagcctcctaacctgctcatttactgggcatctacccgggaatccggggtccctgaccgattcagtggcagcgggtctgggacagatttcactctcaccatcagcagcctgcaggctgaagatgtggcagtttattactgtcagcaatattatggtactcctcacacgttcggccaagggaccaaggtggaaatcaat

SEQ ID NO: 1805 - DNA, 396 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagtttcggcatactatggttcggggagttattatatgagtggttactactactactacggtatggacgtctggggccaagggaccacggtcaccgtctcctca

SEQ ID NO: 1806 - DNA, 327 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaagttcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccctcccacattcactttcggccctgggaccaaagtggatatcaaa

SEQ ID NO: 1807 - DNA, 375 bp, Homo sapiens
gccgtgcaactagtggagtctggaggaggcgtggtccaccctggggggtccctgagactctcctgtgcagcctctgggttcagcgtcagtggcaactacatcagttgggtccgccaggctccagggaagggcccggagtgggtctcagttatctttagcgctggtgacacattctacgcggactccgtgaagggccgcttcatcatctccagagacatttcacagaacacggtgtttcttcagctgaacaacctgagagccgaggacacggccgtttatttctgtgcgagaaaccagagtccccaccgagggagcaatcccgtctattactactttgactattggggccagggaacgctggtcgccgtctcctca

SEQ ID NO: 1808 - DNA, 324 bp, Homo sapiens
caaattgtgttgacacagtctccagccaccctgtctttgtctccaggggaaagtgccaccctctcctgcagggccagtcagagtcttggcagctacttagcctggtaccaacagagacctggccaggctcccaggctcctcatctatgatgcatcccggagggccactggcatcccagccaggttcagtggcagtgggtctgggaccgacttcactctcaccatcaggagcctagagcctgaagattttgctgtttattactgtcaacaaggtggcacctggcctccgtacacttttggccaggggaccaagctggaggtcaaa

SEQ ID NO: 1809 - DNA, 375 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatggtggaactaataaatactatgcagactccgtgaagggccgattcaccatctccagagacaattccaagaacacgctgtatctgcaaatgaacagcctgagagctgaggacacggctgtgtattactgtgcgaaagatcctgcctacgatttttggagtggttatcaggccctctttgactactggggccagggaaccctggtcaccgtctcctca

SEQ ID NO: 1810 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagtaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 1811 - DNA, 384 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagctctgtgaccgccgcagacacggctgtgtattactgtgcgagactaccgaggagttactatgatagtagtggttattataatcgtgcttttgatatctggggccaagggacaatggtcaccgtctcttca

SEQ ID NO: 1812 - DNA, 324 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtgtggtattcggcggagggaccaagctgaccgtccta

SEQ ID NO: 1813 - DNA, 366 bp, Homo sapiens
gaggtgcagctgttggagtctgggggaggcttggcacagccgggggggtccctgagactctcctgtgcagcctctggattcacctttagcagctattccatgagctgggtccgccaggctccagggaaggggctggagtgggtctcagttatcagtggtagtggtggtagcacatactacgcagactccgtgaagggccggttcaccatctccagagacaattccaagaacacgctgtatctgcaaatgaacagcctgagagccgaggacacggccgtatattactgtgcgaaaattagtcgcgagctggttactagggcctactttggctactggggccagggaaccctggtcaccgtctcctca

SEQ ID NO: 1814 - DNA, 321 bp, Homo sapiens
gaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaa

SEQ ID NO: 1815 - DNA, 360 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatcagggtgtcatgaaatacggtatggacgtctggggccaagggaccacggtcaccgtctcctca

SEQ ID NO: 1816 - DNA, 324 bp, Homo sapiens; identical to SEQ ID NO: 80

SEQ ID NO: 1817 - DNA, 375 bp, Homo sapiens
gaggtgcagctggtggagtccgggggaggctttgttcagccgggggggtccctgagagtctcctgtgcagcctctggattcatcttcagtaggttccggatgcactgggtccgccaagctccagggaaggggctggtctgggtctcacgtattgaaagtgatgggaccagttccacttacgcggactccgtgaagggccgattcaccatctccagagacaacgccaagaacacgctgtatctgcaaatgaacagtctgagaaccgacgacacggctgtgtatttctgtgcaagagattactatgatagtcctggtgatccccagtacaactggttcgacccctggggccagggaaccctggtcaccgtctcctca

SEQ ID NO: 1818 - DNA, 327 bp, Homo sapiens
tcctatgaactgacacagccaccctcggtgtcagtgtccccaggacaaccggccaggatcacctgctctggagatgcattggcaaaaaaatatgcttattggtaccagcagaagtcaggccaggccccggtgttggtcatctatgaggacagcaaacgaccctccgggatccctgagagattctctggctccagctcagggacactggccaccttgactatcactggggcccaggtggaggatgaagctgactactactgttactccacagacagcagtggtagtcatagggggatcttcggaactgggaccaaggtcaccgtccta

SEQ ID NO: 1819 - DNA, 378 bp, Homo sapiens
caggttcagctggtgcggtctggagctgaggtgaagaaggctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgaggatgttgatagcagcagctggtactagcagggactactacagtatggacgtctggggccaagggaccacggtcaccgtctcctca

SEQ ID NO: 1820 - DNA, 324 bp, Homo sapiens; identical to SEQ ID NO: 98

SEQ ID NO: 1821 - DNA, 387 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagttatttatagcggtggtagtagcacatactatgcagactccgtgaagggccggttcaccatctccagagataattccaagaacacgctgtatctgcaaatgaacagcctgagagccgaggacacggccgtatattactgtgcgaaagatctggtgggtatagcagtggctggtacggattactactactactacggtatggacgtctggggccaagggaccacggtcaccgtctcctca

SEQ ID NO: 1822 - DNA, 327 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagagaccctcagggatccctgagcgattctctggctccagctcagggacaacagtcacgttgaccatcagtggagtccaggcagaagacgaggctgactattactgtcaatcagcagacagcagtgttacttatcgttgggtgttcggcggagggaccaagctgaccgtccta

SEQ ID NO: 1823 - DNA, 378 bp, Homo sapiens
caggtccagctggtgcaatctggggctgaggtgagggagcctgggacctcggtgaaggtctcctgcaaggcttctggaggcaccttcaccaggtacactctcagctggctgcgacaggcccctggacaagggcttgagtggatgggaaggatcatccctgtccatgacatatcaaactacgcacagaagttccagggcagagtcacaattaccgcggacaaatctacgaatacagcctacatggagctgagcagcctgagatctgaagacacggccgtctattattgtgcgagagggggggattactatgaccgtagtgatttttactacaactatttcgacccctggggccagggaaccgtggtcaccgtctcctca

SEQ ID NO: 1824 - DNA, 330 bp, Homo sapiens
cagtctgccctgactcagcctgcctccgtgtctgggtctcctggacagtcgatcaccatctcctgcactggaaccagcagtgatgttgggacttacaatcttgtctcctggtaccaacagcgcccaggcaaagcccccgaactcatgatttatgagggcactaagcggccctcagggatatctaatcgcttctctggctccaagtctggcaacacggcctccctgacaatctctgggctccaggctgaggacgaggctgaatattattgctgctcatatgccagtagtagaagttttgtcttcggaactgggaccaaggtcaccgtccta

SEQ ID NO: 1825 - DNA, 396 bp, Homo sapiens
caggttcagctggtgcagtctggagctgaggtgaagaagcctggggcctcagtgaaggtctcctgcaaggcttctggttacacctttaccagctatggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagagatcttgcccgggactacgatttttggagtggttattatactcgctactactactacggtatggacgtctggggccaagggaccacggtcaccgtctcctca

SEQ ID NO: 1826 - DNA, 336 bp, Homo sapiens
gatattgtgatgacccagactccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacagcttcctcacacttttggccaggggaccaagctggagatcaaa

SEQ ID NO: 1827 - DNA, 357 bp, Homo sapiens
caggtgcagctggtggagtctgggggaggcgtggtccagcctgggacgtccctgagactgtcttgtaaagcgtccggatttttcttcagtgagaatggcatgcactgggtccgccaggctccaggcaaggggctggagtgggtggcagttatctggcatgatggaataactcaatacaatggagactccgtgaagggccgattcaccatctccagagacaattccaggagcactctgtacctgcaaatgcacagcctgagaggcgaggacacggctatttacttttgtgcgaagtcgagagatggctacaatcacgggctctcctggggccagggaactttggtccacgtctcctta

SEQ ID NO: 1828 - DNA, 336 bp, Homo sapiens
ggtgttgtgatgactcagtctccactctccctgtccgtcacccctggagagacggcctccatctcctgcaggtctagtcagagtgtcatgcatagtaacggaaacaactatgtggattggtacctgcagaagccagggcagtctccacaactcctgatctatttcggttctaagcgggcctccggggtccctgacaggctcagtggccgtgaatcaggcacagatttcacactggaaatcagcagagtggaggctgaggatgttggcatttattattgcatgcaagctctaaatgttcccctcactttcggcggggggaccaaggtggagatcaga

SEQ ID NO: 1829 - DNA, 360 bp, Homo sapiens
caggtgcagcttgaggagtcgggcccaggactggtgaagccttcggagaccctgtccctcacctgcactgtgtctgatttctccatcagcactgattactactggggctggatccggcagcccccagggaagggactggagtggattgcgagtatctatcacagtggaaacatatacttcagcccgtccctcaagagtcgagtcaccctttcagttgacacatccaaaaaccagttctccctgagtctcacttctgtgaccgccgcagacacggccatttattactgtgcgagagatgttcgcagaaactcgtccgggtttgacttctggggccggggaaccctggtcgccgtctcctca

SEQ ID NO: 1830 - DNA, 324 bp, Homo sapiens
gacgtccacttgacccagtctccatcgtccctgtctgcatctgtaggagacagagtcaccctcacttgccgggcaagtcgggacattcgcacctatttgcagtggtatcagcagagaccagggagagcccctaaactcctaatctcttctgcatccactttgcgaaatggggtcccatcaaggttcagtggcagtggatctggcacagatttcactctcaccatcagcggtctgcaacctgaagattttgcaacttactactgtcaacaaacttacagtaccccggcgtggacattcggcccagggaccaaggtggaaatcaaa

SEQ ID NO: 1831 - DNA, 366 bp, Homo sapiens
gaggagcaggcgttggagtctgggggaggcttggtacagcctgggggatccctgagactctcctgtgcagtctctggattcaccttgagcagccatgccatgagctgggtccgccaggctccagggaagggactggagtgggtctcacttatcaatagtgatgagagtaccatacactatgcagactccgtgaagggccggttcaccatctccagagatagttccaagaagacactatatctacaaatgaacagcctgagagtcgaagacacggccgtatatcactgtgcgagaacctatagcagcagctgggggggtgatgcgcttgatatctggggcccaggtacaatggtcaccgtctcttca

SEQ ID NO: 1832 - DNA, 333 bp, Homo sapiens
cagtctgccctgactcagcctgcctccgtgtctgggtctcctggacagtcgatcaccatctcctgcactggagccgccagtgacattggtggttataactatgtgtcctggtaccaggtacacccaggcaaagtccccaaactcatcatttatgatgtcagtgatcggccctcaggggtttctaatcgcttctctggctccaagtctggcaacacggcctccctgaccatctctgggctccaggctgaagacgaggctgattattactgcagctcatatacaagcagaagcactctcggggtcttcggcggagggaccaagctgaccgtccta

SEQ ID NO: 1833 - DNA, 375 bp, Homo sapiens
cagttgcagctacaggagtcgggcccaagacttgtgaggccttcggagaccctgtccctcaaatgtagtgtctctggtgtctccttgggacattctgattcccagtggggctggatccgccagacccccgagaagggtcttgaatatattggcaatattcatcgtcttgggcccaccacctcttataacccatccctcaagaatcggctgactattgctctagacatgtcgacgaatcatttttctttgagactgacgtctgtgagcgccgcggacacggctctatatttctgtgcgcgaggtgcgcggactgcgaattaccccgactggttcttcgacgtctggggccgtggcaccccggtcacagtctcctca

SEQ ID NO: 1834 - DNA, 321 bp, Homo sapiens
gacatccagatgacccagtctccatcctccctgtctgcatctgtaggagacagagtcaccatcacttgccgggcaagtcagaatattgacaactatttaaattggtatcagcagaaaccagggaaagcccctaagctcctgatctatgccgcatccagattgcatagtggggtcccatcaaggttcagtggcagtggatctgggacagattttactctcatcatcagcagtctacaacctgaagatcttgcaacttattactgtcaacagagttacagtaatcctctcactttcggccctgggaccaaagtggatatcaga

SEQ ID NO: 1835 - DNA, 354 bp, Homo sapiens
caggtgcagctgcaggagtcgggcccaggactggtgaagccttcggagaccctgtccctcacctgcactgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagaggtcctagcagcagctggcccgactactggggccagggaaccctggtcaccgtctcctca

SEQ ID NO: 1836 - DNA, 330 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtccta

SEQ ID NO: 1837 - DNA, 363 bp, Homo sapiens
gaggagcagctggttcagtctggacctgaggtgaaaaaggccggggagtctctgaagatctcctgtcagggttctggatacccctttaccagccactggatcggctgggtgcgccagatgcccgggcaaggcctggagtggatgggaatcatctatcccggtgactctgataccagatacagcccgtctttccaaggccaggtcaccatctcagccgacaagtccctcagcaccgcctacctacagtggactagcctgaaggcctcggacaccggcatgtattactgtgcgagacattatggtggtgacccctattggtacttcgatctctggggccgtggcaccctggtcgctgtctcctca

SEQ ID NO: 1838 - DNA, 327 bp, Homo sapiens
gacattgtgttgacgcagtcgccaggcaccctgtctttgtctccaggggagagagccaccctctcctgcagggccagtcagagtgttggcagcagctacttagcctggtaccagcagaaacctggccaggctcccaggctcctcatctatcatgtgtccagcagggccactggcatcccagacaggttcagtggcagtgggtctgggacagacttcactctcaccatcagcagactggagcctgaagattttgcagtgtattactgtcagcaatatggtaactcagcaatgtacacttttggccaggggaccaaggtggagatcaaa

SEQ ID NO: 1839 - DNA, 357 bp, Homo sapiens
caggtcaccttgagggagtctggtcctgcgctggtgaaacccacacagaccctcacactgacctgcaccttctctgggttctcactcaacactcgtggaatgtgtgtgagctggatccgtcagcccccagggaaggccctggagtggcttgcacgcattgattgggatgatgataaatactacagcacatctctggagaccaggctcaccatctccaaggactcctccaaaaaccaggtggtccttacaatgaccaacatggaccctgtggacacagccacgtattactgtgcacggatggtagtgactacgggaattgactactggggccagggaaccctggtcaccgtctcctca

SEQ ID NO: 1840 - DNA, 321 bp, Homo sapiens
gacatccagatgacccagtctccatcctccctgtctgcatctgtaggagacagagtcaccatcacttgccgggcaagtcatagcattagcaggtatttaaattggtatcagcagaaaccagggaaagcccctaacctcctgatctttgctgcgtccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggaaagcaaa

SEQ ID NO: 1841 - DNA, 351 bp, Homo sapiens
gaggtgcaactggtggagtctgggggaggcttggtccagcctggggggtccctgagactctcctgtgcagcctctggaatcaccgtcagtagaaactacatgagctgggtccgccaggctccggggaagggactggagtgggtctcagttatttacagcggtggtagcactttctactcagactccgtgaagggcagattcaccatctccagagacaattccaagaacacgctgtatcttcaaatgaacagcctgagagccgaggacacggctgtgtactactgtgcgagatctatcgcggatgatgcttttgatatctggggccaagggacaatggtcaccgtctcttca

SEQ ID NO: 1842 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggccagaattcactctcacaatcagcagcctgcagcctgaagattttgcaacttattactgtcaacaacttaatagttaccctccggggacgttcggccaagggaccaaggtggagatcgaa

SEQ ID NO: 1843 - DNA, 369 bp, Homo sapiens
cgggtggagctggtgcagtctggggctgaggtgaagaagcctggggcctcactgaaagtttcctgcaagacatctggatacgccttccccagttactatatccactgggtgcgacaggctcctggacatgggcttgagtggatgggagcaatcaaccccagtggtgggaccacaaccttcgcaccgaagttccagggcagactctccatgaccagcgacacgtccacgagtatagtctacatagacctgaacaacctgagacctgaagacacggccgtctatttttgtgcgggctacagcagtgactggcaatcccacaatgatggtcttgatgtctggggccaagggacaagggtcaccgtctcctca

SEQ ID NO: 1844 - DNA, 321 bp, Homo sapiens
gaagttgtgctgactcagtctccagactttcagtctgtgattccaaaggagacagtcaccatcacctgccgggccactcagagcattggtagtagtttacattggtaccagcagaaaccaggtcagtctccaaagctcctcatcaagtatgcctcccagtccttctcaggggtcccctcgaggttcagtggcagtggatctgggtcagatttcaccctcaccatcaatagcctggaagctgaagatgctgcaacgtattactgtcatcagactactactttaccgtacacttttggccaggggaccaagctggagatcaaa

SEQ ID NO: 1845 - DNA, 360 bp, Homo sapiens
cagatcaccttgaaggagtctggtcctacgctggtgaaacccacacagaccctcacgctgacctgcaccttctctgggttctcactcagcactaatggagtgggtatgggctggatccgtcagcccccaggaaaggccctggagtggcttgcactcatttattgggatgatgatcagttctacagcccatctctgaagagcaggctcaccatcaccagggacacctccaaaaaccaggtggtccttacaatgaccaacatggaccctgtggacacagccacatattactgtgcacaagccttctatgagagtttcggtttttactcctggggccagggaaccctggtcaccgtctcctca

SEQ ID NO: 1846 - DNA, 333 bp, Homo sapiens
aattttatgctgactcagccgcactctgtgtcggagtctccggggaagacggtaatcatctcctgcacccgcagcattggcagcattgccagcaactatgtgcagtggtaccagcagcgcccgggcagtgcccccaccattgtggtctttgaggataacgagagaccctctggggtccctgatcggttctctggctccatcgaccgctcctccaactctgcctccctcaccatctctggactgaagactgaggacgaggctgactactactgtcagtcttatgatggctccagtgaattggtattcggcggagggaccaagctgaccgtccta

SEQ ID NO: 1847 - DNA, 357 bp, Homo sapiens
caggtgcagctggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccgtgtattactgtgcgagagaagtagatagtagtggttttttccccccctggggccagggaaccctggtcaccgtctcctca

SEQ ID NO: 1848 - DNA, 324 bp, Homo sapiens
tcctatgagctgacacagccaccctcggtgtcactgtccccaggacagacggccaggatcacctgctctggagatacattgccaaagcaatatgctttttggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtagtacctcttgggtgttcggcggagggaccaagctgaccgtccta

SEQ ID NO: 1849 - DNA, 363 bp, Homo sapiens
caggtgcagctgcaggagtcgggcccaggactggtgaagccttcacagaccctgtccctcacctgcactgtctctggtggctccatcagcagtggtggttacttctggagctggatccgccagcacccagggaagggcctggagtggattgggcacatctatcacagtgggagcacctactacaacccgtccctcaagagtcgagttaccatatcagtagacacgtctaagaaccagttctccctgaagctgagctctgtgactgccgcggacacggccgtgtattattgtgcgagagaaaagatgagcagctcgtccgattttgactactggggccagggaaccccggtcaccgtctcctca

SEQ ID NO: 1850 - DNA, 327 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccagccaggttcagtggcagtgggtctgggacagagttcactctcaccatcagcagcctgcagtctgaagattttgcagtttattactgtcagcagtataataactggcctccgatccggacgttcggccaagggaccaaggtggaaatcaaa

SEQ ID NO: 1851 - DNA, 381 bp, Homo sapiens
cagctgcagctgcaggagtcgggcccaggactggtgaagccttcggagaccctgtccctcacctgcactgtctctggtggctccatcagcagtagtacctactactggggctggatccgtcagcccccagggaaggggctggagtggattgggagtatcttttatagtgggagaacctactacaacccgtccctcaagagtcgagtcaccatatccgtagacacgtccaagaaccagttctccctgaacctgaggtttgttaacgccgcagacacggctgtctattactgtgcgagtccattcgcagcagctggtcccccgttgtggtactactacggtatggacgtctggggccaagggaccacggtcaccgtctcctca

SEQ ID NO: 1852 - DNA, 336 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctataggaataatcagcggccctcaggggtccctgaccgattctctggctccaagtctggcacctcagcctccctggccatcagtgggctccagtctgaggatgaggctgattattactgtgcagcatgggatgacaccctgagtggtccaaattgggtgttcggcggagggaccaagctgaccgtccta

SEQ ID NO: 1853 - DNA, 363 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaactaataaatactacgcagactccgtgaagggccgattcaccatctccagagacaattccaagaacacgctgtatctgcaaatgaacagcctgagagctgaggacacggctgtttattactgtgcgagaacgtacggtggtaattatttaggctactttgactactggggccagggaaccctggtcaccgtctcctca

SEQ ID NO: 1854 - DNA, 321 bp, Homo sapiens
gaaatggtgatgacgcagtctccagccaccctgtctgtgtctccaggggaaagagccaccctctcctgcagggccagtcagagtgttagcagcaagttagcctggtaccagcagaaacctggccagggtccgaggctcctcatctatggtgcatccaccagggccgctggtatcccagccaggttcagtggcagtgggtctgggacagagttcactctcaccattagtagcctgcagtctgaagattttgcagtttatttctgtcagcagtataataactggccgctcactttcggcggcgggaccacggtggagatcaaa

SEQ ID NO: 1855 - DNA, 369 bp, Homo sapiens
caggtccagctggtacagtctggggctgaggtgaagaagcctggggcctcagtgaaggtctcctgcaaggtttccggatacacactcattgaattatccatgcactgggtgcgacaggctcctggaaaagggcttgagtggatgggaggttttgatcctgaagatggtgaaacaatctacgcacagaagttccagggcagagtcaccatgaccgaggacacatctatagacacagcctacatggagctgagcggcctgagatcggaggacacggccgtgtattactgtgcaacagccccccctatgggccgctcacgtacaaactggttcgaagtcaggggccagggaaccctggtcagtgtctcctca

SEQ ID NO: 1856 - DNA, 330 bp, Homo sapiens
cagtctgtgctgactcagccaccctcagcctctgggacccccgggcagagggtcaccatctcttgttctggaagcagctccaacatcggaactaatactgtgaactggtaccagcagctcccggggacggcccccaaactcctcatctatagtaataatcagcggccctcaggggtccctgaccgattctctggctccaagtctggcacctcagcctccctggccatcagtgggctccattctgaggatgaggctgactatttctgtgcagcatgggatgacagcctgaatggttgggtgttcggcggagggaccaagctgaccgtccta

SEQ ID NO: 1857 - DNA, 390 bp, Homo sapiens
caggtgcagctggtggagtctgggggaggcgtggtccagcctgggaggtccctgagactctcctgtgcagcctctggattcaccttcagtagctctgctatgcactgggtccgccaggctccaggcaaggggctggagtgggtggcagttatctcatatgatggaagtgatacatattacgcagactccgtgaagggccgattcaccatctccagagacaattccaagaacacgctgtatctgcaaatgaacagcctgagagatgaggacacggctgtgtattactgtgcgagagatgaggccgaaactagcctaggggggtgggtcaaaccaatgattaactggtacttcgatctctggggccgtggcaccctggtcactgtctcctca

SEQ ID NO: 1858 - DNA, 321 bp, Homo sapiens
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctctgctgcatcccgtttgcaaagtggggtcccatcaaagttcagcggcagtggatctgggacagatttcactctcaccatcagcagcctgcagcctgaagattttgcaacttattactgccaacagtatcatagttacccccccaccttcggccaagggacacgactggagattaaa

SEQ ID NO: 1859 - DNA, 366 bp, Homo sapiens
caggtgcacctgcaggagtcgggcccaggactggtgaagccttcggggaccctgtccctcacctgcgctgtctctggtggctccatcagcagtagtaattggtggagttgggtccgccagcccccagggaaggggctggagtggattggggaaatctatcatagtgggagcaccgactacaacccgtccctcaagagtcgagtcaccatatcagtagacaagtccaagaaccagttctccctgaagctgagctctgtgaccgccgcggacacggccgtgtattactgtgcgagacgattcttctataactggaacgaccacggtatggacgtctggggccaagggaccacggtcaccgtctcctca

SEQ ID NO: 1860 - DNA, 324 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatccatgctaaaaacaaccggccctcagggatcccagaccgattctctggctccagctcaggaaacacagcttccttgaccatcactggggctcaggcggaagatgaggctgactattactgtaactcccgggacagcagtagttaccatcaggtgttcggcggagggaccaagctgaccgtccta

SEQ ID NO: 1861 - DNA, 375 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattggctatatctttcatagtggtagcaccaactacaacccctccctcaagagtcgagtcaccatatcactagacatgtccaagaaccagttctccctgaacctgagctctgtgaccgctgcggacacggccgtgtattactgtgcgacccaggagtatagcagctcgtccgcccttggttactactacggtttggacgtctggggccaagggaccacggtcaccgtctcctca

SEQ ID NO: 1862 - DNA, 318 bp, Homo sapiens
tcctatgagctgactcagccaccctcagtgtccgtgtccccaggacagacagccagcatcacctgctctggagataaattgggtgataaatatgcttgctggtatcagcagaagccaggccagtcccctgtgttggtcatctatcaagatactaagcggccctcagggatccctgagcgattctctggctccaactctgggaacacagccactctgaccatcagcgggacccaggctatggatgaggctgactattactgtcaggcgtgggacagcaacactgcggtattcggcggagggaccgagctgaccgtccta

SEQ ID NO: 1863 - DNA, 372 bp, Homo sapiens
gaggtgcagctggtggagtctgggggaggcttggtccagcctggggggtccctgagactctcctgtgcagcctctggattcacctttagtatctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagtctgagagccgaggacacggctgtgtattactgtgcgagagatcgtcagcgttcggggagttataatccgtacgctatggacgtctggggccaagggaccacggtcaccgtctcctca

SEQ ID NO: 1864 - DNA, 336 bp, Homo sapiens
gatattgtgatgactcagtctccactctccctgcccgtcatccctggagagccggcctccatctcctgcatgtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagggtggaggctgaggatgttggggtttattactgcatgcaagctctacaaaccccgtggacgttcggccaagggaccaaggtggaaatcaaa

SEQ ID NO: 1865 - DNA, 384 bp, Homo sapiens
caggtccacctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccaaaacagagtcaccatgaccgaggacacatctacagacacagcctacatggagctgagcagcctgacatctgaggacacggccgtctattactgtgcaacagaaactccgtatagcagtacctggtatgttttgccgaactactacggtatggacgtctggggccaagggaccacggtcaccgtctcttca

SEQ ID NO: 1866 - DNA, 330 bp, Homo sapiens
caggcagggctgactcagccaccctcgctgtccaagggcttgagacagaccgccacactcacctgcactgggaacagtaacaatgttggcaaccaaggagctgtttggctgcagcagcaccagggccaccctcccaaactcctatcctacaagaataacagccggccctcagggatctcagagagattatctgcatccaggtcaggaaacacagcctccctgaccattactggactccagcctgaggacgaggctgactattactgctcagcatgggacagcagcctcagtgcctgggtgttcggcggagggaccaagctgaccgtccta

SEQ ID NO: 1867 - DNA, 354 bp, Homo sapiens
caggtgcagctgcaggagtcgggcccaggactggtgaagccttcggagaccctgtccctcacctgcactgtctctggtggctccatcaataattactactggagctggatccggcaggccccagggaagggactggagtggattggatatatctattacagtgggagcaccaactacaacccctccctcaagagtcgagtctccatatcactagacacgtccaagaaccagttctccctgaagctgagctctgtgaccgctgcggacacggccgtgtattactgtgcgagagatcggcttttttcttcctactttgactactggggccagggaaccctggtcaccgtctcctca

SEQ ID NO: 1868 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtacctcacctctgtacacttttggccaggggaccaagctggagatcaaa

SEQ ID NO: 1869 - DNA, 366 bp, Homo sapiens
caggtccagctggaacagtctggggctgaggtgaagaagcctggggcctcagtgaaggtctcctgcaaggtttccggatacaccctccctgaaatagccatacactgggtgcggcaggctcctggaaaagggcttgagtggatgggaggttttgatcctgaagatgctgaaacaatctacgcacagaagttccagggcagagtcaccatgaccgaggacacatctacagacacagcctacatggagttgagtagcctgagatctgaggatacggccgtgtattactgtgcgggggcatctcccctagttagcggaattaactggttcgatccctggggccagggaaccctggtcaccgtctcctcg

SEQ ID NO: 1870 - DNA, 330 bp, Homo sapiens
cagtctgtgttgacgcagccgccctcagagtctgcggccccaggacagaaggtcaccatctcctgctctggaagcagctccaacattgggaataattatgtatcctggtaccggcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagtagcctgagtgattatgtcttcggaactgggaccaaggtcgccgtccta

SEQ ID NO: 1871 - DNA, 384 bp, Homo sapiens
caggtgccgctgcaggagtcgggcccaggactggtgaagccttcacagaccctgtccctcacctgcactgtctctggtggctccatcagcagtggtagttactactggagctggatccggcagcccgccgggaaggctctggagtggattgggcatatctataccagtgggagcaccaactacaacccctccctcaagagtcgagtcaccatatcagtagacacgtccaagaaccagttctccctgaagctgagctctgtgaccgccgcagacacggccgtgtattactgtgcgagagagtgggggttttggtatgcctatgattcagggagtttttggtactttgactactggggccagggaaccctggtcaccgtctcctca

SEQ ID NO: 1872 - DNA, 324 bp, Homo sapiens
gacatccagatgacccagtctccttccaccctgtctgcatctgtaagagacagagtcagcatcacttgccgggccagtcagagtattagtagctggttggcctggtatcagcagaaaccagggaaagcccctaaggtcatgatctataaggcgtctagtttagaaagtggggtcccatcaaggttcagcggcagtggatctgggacagaattcactctcaccatcagcagcctgcagcctgattattttgcaacttattactgtcaacagtatgaaagttatcctatgtacacttttggccaggggaccaagctggagatcaaa

SEQ ID NO: 1873 - DNA, 360 bp, Homo sapiens
caggtgcagctggtggagtctgggggaggcgtggtccagcctgggaggtccctgagactctcctgtgcagcctctggattcaccttcaatagctatgctatgcactgggtccgccaggctccaggcaaggggctggagtgggtggcagttatctcgtatgatggagataataaatactacgcagactctgtgaatggccgattcaccttctccagagacaattccaagaacgcactgtatttgcaaatgaacagtctgagacctgaggacacggctgtgtattactgtgcgaggggtggtgggaactacttcacctactttgactactggggccagggaaccctggtcaccgtctcctca

SEQ ID NO: 1874 - DNA, 324 bp, Homo sapiens
gaaatagtgatgacgcagtctccagccaccctgtctgtgtctccaggggaaagagccaccctctcctgcagggccagtcagagtgttaatagcaagttagcctggtaccagcagagacctggccaggctcccaggctcctcatctatggtgcgtccaccagggccactggtatcccagccaggttcagtggcagtgggtccgggacagagttcactctcaccatcagcagcctgcagtctgaagattttgcagtttattactgtcagcagtataatagctggcctccgaacacttttggccaggggaccaagctggagatcaaa

SEQ ID NO: 1875 - DNA, 363 bp, Homo sapiens
caggtgcagctggtggagtctgggggaggcgtggtccagcctgggaggtccctgagactctcctgtgcagcgtctggattcaccttcagtcactatggcatgcattgggtccgccaggctccaggcaaggggctggagtgggtggcagttatatggtatgatggaactaagaaatactatgcagactccgtgaagggccgattcaccatctccagagacaattccaagaacacgctgtatctgcaaatgaacagcctgggagccgaggacacggctgtctattactgtgcgagatcgaaatggctacaaataagagcgggctgtgactactggggccagggaaccctggtcaccgtctcctca

SEQ ID NO: 1876 - DNA, 336 bp, Homo sapiens
gatattgtgatgacccagaatccactctctctgtccgtcacccctggacagccggcctccatctcctgcaagtctagtcagagcctcctgcatagtgatggaaagacctatttgtattggtacctgcagaagccaggccagcctccacagctcctgatctatgaagtttccaaccggttctctggagtgccagataggttcagtggcagcgggtcaggggcagatttcacactgaaaatcagccgggtggaggctgaggatgttgggatttattactgcatgcaaagtatacagcttcccctcactttcggcggagggaccaaggtggagatcaaa

SEQ ID NO: 1877 - DNA, 354 bp, Homo sapiens
gaggtacagctgttggagtcggggggaggcttggttcagcctggggggtccctgagactctcctgtgcagcctctggattcctcgttaacgactatgccatgggctgggtccgccaggctccagggaaggggctggagtgggtctcagccattagtggaagtggtcttagtagaacgttctacgcagactccgtgaggggacacctcacaatctccagggacaattccaggaacacactgtatctgcaaatgagcagcctgagagccgaagacacggccatatattactgtgcgactcgggacactactaagatgatacactggggccagggaaccctggtcaccgtctcctcc

SEQ ID NO: 1878 - DNA, 321 bp, Homo sapiens
gacgtccagatgacccagtctccatcctccctgtctgcatctgttggagacagagtcaccatcacttgccgggcgagtcaggacattgacaatgttttggcctggtatcagcaaaaaccagggaaacgtcctaagctcctgatctatactgcatccaccttacaattaggagtcccatctcggttcagaggcagtggatctgggacagatttcactctcaccatcagcagcctgcagcctgaagatattggaacttattactgtcaaaagtatgacggtgccccgtggacgttcggccaagggaccaaggtggaaatcaaa

SEQ ID NO: 1879 - DNA, 384 bp, Homo sapiens
gaagtgcagctggtggagtctgggggaggcttggtacagcctggcaggtccctgagactctcctgtgcagcctctggattcagctttgatgattatgccatgcactgggtccggcaagctccagggaagggcctggagtgggtctcaggtatgagttggaatagtggtaccagaggctatgcggactctgtgaagggccgattcaccatctccagagacaacgccaagaactccctgtatctgcaaatgaacagtctgagacctgaggacacggccttgtattactgtgtaaaagcatattgtggtggtgattgctattccctggtttttgccagtgatgcttttgatatctggggccaagggacaatggtcaccgtctcttca

SEQ ID NO: 1880 - DNA, 330 bp, Homo sapiens
cagtctgtgttgacgcagccgccctcagtgtctgcggccccaggacagaaggtcaccatctcctgctctggaagcagctccaacattgggaataattttgtatcctggtaccagcagttcccaggaacagcccccaaactcctcatttatgacaataataagcgaccctcagggattcctgaccgcttctctggctccacgtctggcacgtcagccaccctgggcatcaccggactccagactggggacgaggccgattattactgcggaacatgggatagcagcctgagtgctggagtcttcggcggagggaccaagctgaccgtccta

SEQ ID NO: 1881 - DNA, 396 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtgataaatactatgcagactccgtgaagggccgattcaccatctccagagacaattccaagaacacgctgtatctgctaatgaacagcctgagagccgaggacacggctgtgtattactgtgcgagagatggcatggaaaaatattgtagtggtggtagctgctactttacccaagtagcctactactttgactactggggccagggaaccctggtcaccgtctcctca

SEQ ID NO: 1882 - DNA, 321 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagtgtagcaactggcctccgacgttcggccaagggaccaaggtggaaatcaaa

SEQ ID NO: 1883 - DNA, 366 bp, Homo sapiens
caggtgcagctggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactggggacccaacgtatgcccagggcttcacaggacggtttgtcttctccttggacacctctgtcaacacggcatatctgcagatcagcagcctaaaggctgaggacactgccgtgtattactgtgcgagacccaatttcagtggctggtactcgtctgcttttgatatctggggccaagggacaatggtcaccgtctcttca

SEQ ID NO: 1884 - DNA, 324 bp, Homo sapiens
gaaatagtgatgacgcagtctccagccaacctgtctgtgtctccaggggacagagccaccctctcctgcagggccagtcagagtgtttacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtattataactggcctcggtggacgttcggccaagggaccaaggtggaaatcaaa

SEQ ID NO: 1885 - DNA, 351 bp, Homo sapiens
gaggtgcagctggtggagtctgggggaggcttggtccagcctggggggtccctgagactctcctgtgcagcctctggattgaccgtcagtagcaactacatgagctgggtccgccaggctccagggaaggggctggagtgggtctcaattatttatagcggtggtaccacttactacgcagactccgtgaagggcagattcaccatctccagagacacatccaagaacacgctgtatcttcagatgaacagcctgagagccgaggacacggctgtgtattactgtgcgagagatgttatggttcggggagttatggactggggccagggaaccctggtcaccgtctcctca

SEQ ID NO: 1886 - DNA, 327 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctggcacagagttcactctcaccatcagcagcctgcagtctgaagattttgcagtttattactgtcagcagtataatgactggcctccgaggtacacttttggccaggggaccaagctggagatcaaa

SEQ ID NO: 1887 - DNA, 369 bp, Homo sapiens
gaggtgcagctggtggagtctgggggaggcttggtacagcctggggggtccctgagactctcctgtacagcctctgggttcaccttcagtaggtacgacatgcactgggtccgccaagctacaggaaaaggtctggagtgggtctcagctattggaactgctggtgacacatactatccaggctccgtgaagggccgattcaccatctccagagaaaatgccaagaactccttgtatcttcaaatgaacagcctgagagccggggacacggctgtatattattgtgcaagagcccctagagactaccatattttgacctcaggggcttttgatatctggggccaagggacaatggtcaccgtctcttca

SEQ ID NO: 1888 - DNA, 324 bp, Homo sapiens
gaaataatgatgacgcagtctccagccaccctgtctgtgtctccaggggaaagagccaccctctcctgcagggccagtcagagtgttaacagcaacttagcctggtaccagcagaaacctggccaggctcccaggctcctcctctatggtgcatccaccagggccactggtatcccaggcaggttcagtggcagtgggtctgggacagagttcactctcaccatcagcagcctgcagtctgaagattttgcagtttattactgtcagcagtatcataactggcctccgctcactttcggcggagggaccaaggtggagatcaaa

SEQ ID NO: 1889 - DNA, 381 bp, Homo sapiens
gaggtgcacctggtggagtctgggggaggcctggtcaagcctggggggtccctgagactctcctgtgcagcctctggattcaccttcagtaactatggcatgaactgggtccgccaggctccagggaaggggctggagtgggtctcgtccattagtagtagtagtaatttcatatacgtcgcagactctctgaagggccgcttcaccatctcccgagacaacggcaagaactcactgtatctgcaaatgaacagcctgagagccgaggacacggctgtgtattactgtgcgagagatgagagactttacgattttttgactgattattataaaggcccgcttgactactggggccagggaaccctggtcaccgtctcctca

SEQ ID NO: 1890 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtattataactggcctccgtggacgttcggccaagggaccaaggtggaaatcaaa

SEQ ID NO: 1891 - DNA, 363 bp, Homo sapiens
caggtgcagctggtggagtctgggggaaccgtggtccagcctgggaagtccctgagactctcctgtgcagcctctggattcatcttcagtacctatgctataaattgggtccgccaggctccaggcaaggggctggagtgggtggcagttatatcatatgatggaaataataaatattacgcagactccgtgaagggccgattcaccatctccagagacaattccaagaacacggtgtttctgcaaatgaacagcctgagagctgaggacacggctatgtattactgtgcgagaccccgcggtgggggatacagggatgcttttgatatctggggccaagggacaatggtcaccgtctcttca

SEQ ID NO: 1892 - DNA, 321 bp, Homo sapiens
gacatccagatgacccagtctccttccaccctgtctgcatctgtaggagacagagtcaccatcacttgccgggccagtcagagtattagtacctggttggcctggtatcagcagaaaccagggaaagcccctaagctcctaatctataaggcgtctagtttagaaggtggggtcccatcaaggttcagcggcagtggatctgggacagaattcactctcaccatcagcagcctgcagcctgatgattttgcaacttattactgccaacagtataatacttatccttggacgttcggccaagggaccaaggtggaaatcaaa

SEQ ID NO: 1893 - DNA, 357 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggagaaatctatcatagtgggaacaccaactacaacccgtccctcaagagtcgagtcaccacatcagtagacaagtccaagaaccagatctccctgaggttgagctctgtgaccgccgcggacacggccgtgtatttctgtgcgagacgaatggttcagggaggtggtcttgactactggggccagggaaccctggtcaccgtctcctca

SEQ ID NO: 1894 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagctcagtaagcggccctcaggggtttctaatcgcttctctggctccaagtctggcaacacggcctccctgacaatctctgggctccaggctgacgacgaggctgattattactgctggtcatatgcaggttttagcagctgggtgttcggcggagggaccaagctgaccgtccta

SEQ ID NO: 1895 - DNA, 348 bp, Homo sapiens
gaggtgcagctggtggagtctggaggaggcttggtccagcctggggggtccctgagactctcctgtgcagcctctgggttcaccgtcagtagcaactacatgaactgggtccgccaggctccagggaaggggctggagtgggtctcagttatttatagcggtggtagcacatactacgcagactccgtgaagggccgattcaccatctccagacacaattccaagaacacgctgtatcttcaaatgaacagcctgagagccgaggacacggccgtgtattactgtgcgagagacgcgtatcactacggtgaggactggggccagggaaccctggtcaccgtctcctca

SEQ ID NO: 1896 - DNA, 336 bp, Homo sapiens
cagcttgtgctgactcaatcgccctctgcctctgcctccctgggagcctcggtcaagctcacctgcactctgagcagtgggcacagcagctccgccatcgcatggcttcagcagcagccagagaagggccctcggtacttgatgaacgttaacagtgatggcagccacagcaagggggacgggatccctgatcgcttctcaggctccagctctggggctgagcgctacctcaccatctccagcctccagtctgaggatgaggctgactattactgtcacacctggggcactgacatccattgggtgttcggcggagggaccaagctgaccgtccta

SEQ ID NO: 1897 - DNA, 360 bp, Homo sapiens
gaggtgcagctggtggagtctgggggagacttggtccagcctggggggtccctgagactctcttgtgcagcctctggattcagtttcagtgtctatggtatgcactgggtccgccaggctccagggaagggactggaatatgtttcaggtattagtactaatggggatagcacatattatgcaaactctgtgaagggcagattcaccatctccagagacaaatcgaagaacacgctgtttcttcaaatgggcaacctgagagctgaggacatggctatatattactgtgcgacaactactcctgcccccggggactactttgactactggggccagggaaccctggtcaccgtctcctca

SEQ ID NO: 1898 - DNA, 327 bp, Homo sapiens
tcctatgtgctgactcagccaccctcagtgtcagtggccccaggaaagacggccaggattacctgtgggggaaacaacattggaagtaaaagtgtgcactggtaccagcagacgccaggccaggcccctgtcctggtcatctattatgataacgaccggccctcagggatccctgagcgattctctggctccaactctgggaacacggccaccctgaccatcagcagggtcgaagccggggatgaggccgactattactgtcaggtgtgggatagtagtagtgatcctcattatgtcttcggaactgggaccaaggtcaccgtccta

SEQ ID NO: 1899 - DNA, 366 bp, Homo sapiens
gaggtgcagctggtggagtctgggggaggcctggtcaagccgggggggtccctgagactctcctgtgcagcctctggattcaacttcaatagctttggcatgaactgggtccgccaggctccagggaaggggctggagtgggtctcattcattagtagtagtagtagtttcatatactacgcggactcagtgaagggccgattcagcatctccagagacaacgccaagaactcactgtatctgcaaatgaacagcctgagagccgaggacacggctgtctattattgtgcgagagatccgcataattactttggttcggggagttctgactactggggccagggaaccctggtcaccgtctcctca

SEQ ID NO: 1900 - DNA, 324 bp, Homo sapiens
gaaatagtgatgacgcagtctccagccaccctgtctgtgtctccaggggaaagagtcaccctctcctgcagggccagtcagagtgttagcagcaacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttgcagtttattactgtcagcagtattataactggcctccgtggacgttcggccaagggaccaaggtggacatcaaa

SEQ ID NO: 1901 - DNA, 363 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctgaagtgggtggcagttatatggtatgatggaagtaataaatactatgcagactccgtgaagggccgattcaccatctccagagacaattccaagaacacggtgtatctacaaatgagcagcctgagagccgacgacacggctgtgtatttctgtgcgagagaggggatttacggtgactacactgggattgactactggggccagggaaccctggtcaccgtctcctca

SEQ ID NO: 1902 - DNA, 327 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaagacagcagacgaccctccgggatccctgagagattctctggctccagctcagggacaatggccaccttgactatcagtggggcccaggtggaggatgaagctgactactattgttactcaacagacagcagtgataatcataagtgggtgttcggcggagggaccaagctgaccgtccca

SEQ ID NO: 1903 - DNA, 366 bp, Homo sapiens
gaggtgcagctgttggagtctgggggaggcttggtacagtctggggggtccctgagactctcctgtgcagcctctggattcacctttagcagctatgccatgagctgggtccgccaggctccagggaaggggctggagtgggtctcaagtattgttggtagtggtggtagaacaaactacgcagactccgtgaagggccggttcaccatctccagagacaattccaagaacacgctgtatctgcaaatgaacaccctgagagccgaggacacggccgtatatttctgtgcgaaagattgtagcagctgctatgcttcaggcgggtttgactgctggggccagggaaccctggtcaccgtctcctca

SEQ ID NO: 1904 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaaactcctcatctataaggcgtctagtttagaaagtggggtcccatcaaggttcagcggcagtggatctgggacagaattcactctcaccatcagcagcctgcagcctgatgattttgcaacttattactgccaacagtatgataattacccgtggacgttcggcccagggaccaaggtggaaatcaaa

SEQ ID NO: 1905 - DNA, 363 bp, Homo sapiens
caggtgcagctggtgcagtctggggctgaggtgaagaagcctgggacctcagtgaaggtttcctgcaaggcatctggatacaccttcaccagctactatatgcactgggtgcggcaggcccctggacaagggcttgagtggatgggaataatcaaccctagtggtggaggcacaagcaacgcacagaagttccagggcagagtcaccatgaccagggacacgtccacgagcacagtctacatggaactgagcagcctgagatccgaggacacggccgtgtattactgtgcgagagactcgtactatggtgcggggagtctgtttggctactggggccagggaaccctggtcaccgtctcctca

SEQ ID NO: 1906 - DNA, 321 bp, Homo sapiens
gacatccagatgacccagtctccatcctccctgtctgcatctgtagaagacagagtcaccatcacttgccgggcaaatcagagcattagcaactatttaaattggtatcagcagaaaccagggaaaggccctaagctcctgatctatgctgcatccagtttgcaaagtggggtcccatcaaggttcagtggcagtggatctgggacagatttcactctcaccatcagcagtctgcaacctgaagattttgcaacttattactgtcaacagagttacagtacccctcccaccttcggccaagggacacgactggagattaaa

SEQ ID NO: 1907 - DNA, 351 bp, Homo sapiens
gaggtggagctggtggagtctgggggaggcttggtccagcctggggggtccctaagactctcctgtgtagcctctggattcacctttagttcctcttggatggcatggttccgccaggctccagggaaggggctggagtgggtggccgacataaatcaagatgcaagttcccaatactatgtggactctgtgcagggccgattcaccatctccagagacaacgccaagaattcagtgtttctccaaatgaacagcctgcgagtcgacgacacggctgtatatttctgtgcgaccatccgtgcctactgctcccattcctggggccagggaatcctggtcaccgtctcctca

SEQ ID NO: 1908 - DNA, 330 bp, Homo sapiens
cagtctgccctgactcagcctccctccgcgtccgggtctcctggacagtcagtcaccatctcctgcactggaaccagcagagacgttggtcgttatgactttgtctcttggtaccaacaacacccaggcaaagcccccaaggtcatgatttttgaggtcaataagcggccctcaggggtccctgatcgcttctctggctccaagtctggcaacacggcctccctgaccgtctctgggctccagtttgaggatgaggctgactattactgcagcgcacatgcaggaaacacccatgtgatatttggcggggggaccaaactgaccgtccta

SEQ ID NO: 1909 - DNA, 387 bp, Homo sapiens
caggtccagctggtacagtctggggctgaggtgaagaagcctggggcctcagtgaaggtctcctgcaaggtttccggatacaccctcgttgaattatccatgcactgggtgcgacaggctcctggaaaagggcttgagtggatgggaggttttgatcctgaagctggtgaaacaatctacgcacagaagttccagggcagagtcaccatgaccgaggacacatctacagacacagcctacatggagctgagcagcctgagatctgaggacacggccgtgtattactgtgcaacagggccacctacgttgaccgattactatggttctagggttcttttgggctggttcgacccctggggccagggaaccctggtcaccgtctcctca

SEQ ID NO: 1910 - DNA, 327 bp, Homo sapiens
gaaattgtgttgacgcagtctccaggcaccctgtctttgtctccaggggaaagagccaccctctcctgcagggccagtcagagtgttaccagcaactacttagcctggtacaagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacccttgtacacttttggccaggggaccaagctggagatcaga

SEQ ID NO: 1911 - DNA, 360 bp, Homo sapiens
gaggtgcagctgttggagtctgggggaggcttggtacagcctggggggtccctgagactctcctgtgcagcctctggattcacctttagcagctatgtcatgaactgggtccgccaggctccagggacggggctggagtgggtctcaggtattagtggtagtggtggtgcctcatactccgcagactccgtgaagggccggttcaccatctccagagacaattccaagaacacgctctatctccaaatggacagcctgagagccgaggacacggccttatattactgtgcgaaaccccggggtggtaaccccttcgactttgactactggggccagggaaccctggtcaccgtctcctca

SEQ ID NO: 1912 - DNA, 336 bp, Homo sapiens
gacatcgtgatgacccagtctccagactccctggctgtgtctctgggcgagagggccaccatcaactgcaagtccagccagagtgttttgtacagccccaacaataagaactacttagcttggtaccagcagaaaccaggacagcctcctaagctgctcatttactgggcatctacccgggaatccggggtccctgaccgattcagtggcagcgggtctgggacagacttcactctcaccatcagcagcctgcaggctgaagatgtggcagtctattactgtcagcaatattatagttggtacacttttggccaggggaccaggctggagatcaaa

SEQ ID NO: 1913 - DNA, 354 bp, Homo sapiens
caggtgcagctgcaggagtcgggccctggactggtgaagccttcggagaccctgtccctcacctgcactgtctctggtggctccatcagtagttactactgcagttggctccggcaacccccagggaagggactggaatggattggccatatctcttacgatgggaccaccaactacagcccctccctcaaaagtcgagtcaccctgtcagtggacacgtccaagaagcagatctcactgcacctgagttctgtgaccgctgcggacacggccgtctattactgtgcgaggtcgcgctataggagttccctgatcgacaactggggccagggatccctggtcaccgtctcctca

SEQ ID NO: 1914 - DNA, 330 bp, Homo sapiens
cagtctggcctgactcagccaccctcagtgtctgggacccccgggcagagagtcaccatctcttgttctggaagcagctccaacatcggaagatatcctgtaaattggtatcaacacgtcccaggaacggcccccaaactcctcatctatagtaataatcagcggccctcaggggtccctgaccaattctctggctccaagtctggcacctcagcctccctggccatcagtggactccagtctgagattgaggctgattattactgtgcagcatgggatgagagcctggatgctgtggtgttcggcggggggaccaagctgaccgtccta

SEQ ID NO: 1915 - DNA, 357 bp, Homo sapiens
caggtgcgactggtggagtctgggggaggcgtggtccagcctgggaggtccctgagactctcctgtgtagcctctggattgacgttcagtgactatgctatgcactgggtccgccaggctccaggcaaggggctggaatggctggcacttattgcctctgatggaagcaataagtattacgcagactcgttggagggccgactcaccatctccagagacaactccaacaataccgtgtatcttcaaatggacagcctgagacctgaggacacggcattttattactgtgcgacagaggtgtggtacagtacgaggacgtcttggtggggccagggaatcctggtcagcgtctcttca

SEQ ID NO: 1916 - DNA, 324 bp, Homo sapiens
gaaatagtgatgacgcagtctccagccaccgtgtctgtgtccccaggggaaagagtcaccctctcctgcagggccagtcagagtgtgagcaccaacttagcctggtaccagcagaaacctggccaggctcccaggctcctcatctttggtgcatccaccagggccactgatatcccagccaggttcagtggcagtgggtctgggacagagttctctctcaccatcaacagcctgcagtctgaagattttgcagtttattattgtcaggaatataagaactggctcacgtggacgttcggccaagggaccaaggtggaaatcaaa

SEQ ID NO: 1917 - DNA, 357 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggccgttatatcatatgatggaagcaataaatactacgcagactccgtgaggggccgattcaccatctccagagacaattccaagaacacgctgtatctgcaaatgaacagcctgagacctgaggacacggctgtatattactgtgcgagggcgagtagtgcttattactattttgactactggggccagggaaccctggtcaccgtctcctca

SEQ ID NO: 1918 - DNA, 318 bp, Homo sapiens
gaaattgtgttgacacagtctccagccaccctgtctttgtctccaggggaaagagccaccctctcctgcagggccagtcagagtgttagcagctacttagcctggtaccaacaaaaacctggccaggctcccaggctcctcatctatgatgcatcctacagggccactggcgtcccagccaggttcagtggcagtgggtctgggacagacttcactctcaccatcagcagcctagagcctgaagattttgcagtttattactgtcagcagcgtcgcaactcgctcactttcggcggagggaccaaggtggagatcaaa

SEQ ID NO: 1919 - DNA, 378 bp, Homo sapiens
caggaccagctggtgcagtctggggctgaagtgaagaagcctgggtcctcggtgagggtctcctgcaaggcttctggagacacctcgaagaactatgctatcacctgggtgcgacaggcccctggacaagggcttgagtgggtgggaaggatcatccctctccttggtgtaacaaactacgcacagaagttccagggcagagtcactattacggcggacaaatccacgagaacagcctacatggaggtgaacaccctgagacccgaggactcggccgtctattactgtgcgagaaggacttacccgtccctaagtactgtgtactattaccatggtatggacgtctggggccaagggaccacggtcaccgtctcctca

SEQ ID NO: 1920 - DNA, 333 bp, Homo sapiens
gaaatagtgatgactcagtctccactctccctgcccgtcacccctggagagtcggcctccatctcctgcaggtctagtcagagcctcctgcatggtgatggacacaactatttggattggtacgtgcagaagccagggcagcctccacagctcctgatctatctgggctcaagtcgggcctccggggtccctgacaggttcagtggcagtggatcaggcacggattttacactgaaaatcagcagagtggaggctgacgatgttggagtttattactgcatgcaatctcgacaaactgttactttcggcggagggaccaaggtggagatcaaa

SEQ ID NO: 1921 - DNA, 372 bp, Homo sapiens
gaggtgcagctggtggagtcggggggaggcttggtccagcctggggggtccctgagactctcctgtgcagcctctggattcacctttagtagatattggatgaactgggtccgccaggctccagggaaggggctggagtgggtggccaacatagaccaagatgcaagtgagaaatactatgtggactctgtgcagggccgattcaccatctccagagacaacgccaagaactcactgtatctgcaaatgaacagcctgagagccgaggacacggctgtgtattactgtgcgagagatccggaagatgtctacggtgactacggtgggatgaatgactactggggccagggaaccctggtcaccgtctcctca

SEQ ID NO: 1922 - DNA, 321 bp, Homo sapiens
gccatccggatgacccagtctccatcctcattctctgcatctacaggagacagagtcaccatcacttgtcgggcgagtcagggtattagcagttatttagcctggtatcagcaaaaaccagggaaagcccctaagctcctgatctttggtgaatccactttgcacagtggggtcccatcaaggttcagcggcagtggatctgggacagatttcactctcaccatcagccgcctgcagtctgaagattttgcaacttattactgtcaacagtattatagttaccctctgacgttcggccaagggaccaaggtggaaatcaaa

SEQ ID NO: 1923 - DNA, 375 bp, Homo sapiens
caggtgcaactgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcaccaacttcaacccgtccctcaagagtcgagtcaccttatcagtagacaagtccaagaaccggttctccctgaagctgacctctgtgaccgccgcggacacggccgtgtattactgtgcgaggatgaggtattactatggttcaggaaattatccatactactttgactactggggccagggaaccctggtcaccgtctcctca

SEQ ID NO: 1924 - DNA, 324 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatgataacaacattcggccctcaggggtccctgaccgattctctggctcccagtctggcacctcagcctccctggccatcactgggctccaggctgaggatgaggctgattattactgccaatcctatgacagcagcgtaatattcggcggagggaccaagctgaccgtccta

SEQ ID NO: 1925 - DNA, 369 bp, Homo sapiens
cagctgcagctgcaggagtcgggcccaggactggtgaagccttcggagaccctgtccctcacctgcactgtctctggtggctccatcagcagtagtaattactactggggctggatccgccagcccccagggaaggggctggaatggattgggaatatctattatagtggtatctcctactacaacccgtccctcaagagtcgagtcaccatgtccgtagacacgtccaagaaccagttctccctgaagctgaactctgtgaccgccgcagacacggctgtgtattactgtgcgagaacaattgattcggtgaattattataatgtgcttgactactggggccagggaaccctggtcaccgtctcctca

SEQ ID NO: 1926 - DNA, 321 bp, Homo sapiens
gacatccagatgacccagtctccatcctccctgtctgcatctgtaggagacagagtcaccatcacttgccgggcaagtcagggcattagaaatgatttaggctggtttcagcagaaaccagggaacgcccctaagcgcctgatctatactgcatccagtttgcaaagtggggtcccatcaagattcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 1927 - DNA, 360 bp, Homo sapiens
gaggtgcagctggtggagtctgggggaggcttggtacagcctggggggtccctgagactctcctgtgcagcctctggattcaccttcagtagctacgacatgcactgggtccgccaagttccaggaaaaggtctggattgggtctcaactattggtactgctggtgacacatactatccaggctccgtgaagggccgattcaccatctccagagaaaatgccaagaactccttgtatcttcaaatgaacagcctgagcgccggggacacggctgtgtattactgtgcgcggggcggaatgattacggtgactaccacctttgactactggggccagggaaccctggtcaccgtctcctca

SEQ ID NO: 1928 - DNA, 324 bp, Homo sapiens
gacatccagatgacccagtctccatcctccctgtctgcatctgtaggagacagagtcaccctaacttgccgggcaagtcagaccattagcagttatttaaattggtatcagctgaaaccagggacagcccctaagctcctgatctatgctgcatccagtttgcaaagtggagtcccatcaaggttcagtggcagtggatctgggacagatttcactctcaccatcagcagtctgcaacctgaagattttgcaacttactactgtcaacagagttacagtaacccctcgatcaccttcggccaagggacacgactggagattaaa

SEQ ID NO: 1929 - DNA, 387 bp, Homo sapiens
gaggtgcaactggtggagtctgggggaggcttggtaaagcctggggggtcccttagactctcctgtgcagcctctggattcactttcactaacgcctggatgagctgggtccgccaggctccagggaaggggctggagtgggttggccgtattaaaagcaaaactgatggtgggacaactgactacgctgcacccgtgaaaggcagattcaccatctcaagagatgattcaaaaaaaacgctgtatctgcaaatgaacagtctgaaaaccgaggacacagccctgtattactgtaccacagatcggcggggggttcggggatttatggaaatagtcgtctacaatatggacgtctggggccaagggaccacggtcaccgtctcctca

SEQ ID NO: 1930 - DNA, 333 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctccttgggtgttcggcggagggaccaagctgaccgtccta

SEQ ID NO: 1931 - DNA, 387 bp, Homo sapiens
caggtccagctggtacagtctggggctgaggtgaagaagcctggggcctcagtgaaggtctcctgcaaggtttccggatacaccctccctgaattatccatacactgggtgcgacaggctcctggaaaagggcttgagtggatgggaggttttgatcctgaaaatgctgaaacaatctacacacagaagttccagggcagactcaccatgaccgaggacacatctacagacacagcctacatggagctgagcagcctgagatctgaggacacggccatgtattactgtgcaacaagttttgtactaatgccggctgctctgggggattactcctactactacggtatggacgtctggggccaagggaccacggtcaccgtctcctca

SEQ ID NO: 1932 - DNA, 336 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctctcactttcggcggagggaccaaggtggagatcaaa

SEQ ID NO: 1933 - DNA, 351 bp, Homo sapiens
gaggtgcagttggtggagtctgggggaggcttggtccagcctggggggtccctgagactctcctgtgcagcctctagaatcaccgtcagtagcaactacatgaactgggtccgccaggctccagggaaggggctggagtgggtctcagttatttatagcggtggtagcacattctacgcagactccgtgaagggcagatttaccatctccagagacagttccaagaatacgctgtatcttcaaatgaacagcctgagagccgaggacacggctgtgtattactgtgcgagagatttcagggaggatgcttttgatatgtggggccaagggacaatggtcaccgtctcttca

SEQ ID NO: 1934 - DNA, 324 bp, Homo sapiens
gacatccagttgacccagtctccatccttcctgtctgcatctgtaggagacagagtcaccatcatttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagtcaccctcaggtcactttcggccctgggaccaaagtggatatcaaa

SEQ ID NO: 1935 - DNA, 381 bp, Homo sapiens
gaagtgcagctggtggagtctgggggaggcgtggtacagcctggggggtccctgagactctcctgtgcagcctctggattcacctttgatgattatgccatgcactgggtccgtcaagttccagggaagggtctggagtgggtctctcttattagtggggatggtggtagcacatactatgcagactctgtgaagggccgattcaccatctccagagacaacagcaaaaactccctgtatgtgcaaatgaacagtctgagaactgaggacaccgccttgtattactgtgtaaaagatagagggggcagtggctgggacctcaaccactactactacggtatggacgtctggggccaagggaccacggtcaccgtctcctca

SEQ ID NO: 1936 - DNA, 321 bp, Homo sapiens
gacatccagttgacccagtctccatccttcctgtctgcatctgtaggagacagagtcaccgtcacttgccgggccagtcagggcattagcagttatttagcctggtatcagcaaaaaccagggaaagcccctaagctcctcatctatgctgcatacactttgcaaagtggggtcccatcaaggttcagcggcagtggatctgagacagaattcactctcacaatcagcagcctgcagcctgaagattttgcaacttattactgtcaacaggttaagagttaccctctcactttcggcggagggaccaaggtggagatcaaa

SEQ ID NO: 1937 - DNA, 369 bp, Homo sapiens
caggtgcagctggtggagtctgggggaggcttggtcaagcctggagggtccctgagactctcctgtgcagcctctggattcaccttcagtgactactacatgtcctggatccgccaggctccagggaaggggctggagtgggtttcatacattagtagtagtgctagtaccaagaactacgcagactctgtgaagggccgattcaccatctccagggacaacgccaagaactcactgtatctgcaaatgaacagcctgagagccgaggacacggccgtgtattactgtgcgagagattggaacctgtataacaactcgtttccagcggtggactactggggccagggaaccctggtcaccgtctcctca

SEQ ID NO: 1938 - DNA, 321 bp, Homo sapiens
gacatccagatgacccagtctccatcctcactgtctgcatctgtcggagacagagtcaccgtcacttgtcgggcgagtcagggcattagcaattatttagcctggtttcagcagaaaccagggaaagcccctaagtccctgatctatgctgcatccagtttgcaaagtggggtcccatcaaagttcagcggcagtggatctgggacagatttcactctcaccatcagcaacctgcagcctgaagatttcgcaacttattactgccaacagtataagagttaccctctcactttcggcggagggaccaaggtggagatcaaa

SEQ ID NO: 1939 - DNA, 363 bp, Homo sapiens
gaggtgcagctgttggagtctgggggaggcttggtacagcctgggggatccctgagactctcctgtgcagcctctggattcacctttagcaactatgccctgaactgggtccgccaggctccagggaaggggctggagtgggtctcaagtattactggtggtggtggcaccacgtactacgcagaccccgtgaagggccgcttcaccatctccagagacaattccaagaacacgctgtatctgctaatggacagcctgagagccgaagacacggccgtatattactgtgcgagcccccgttcgctttacagttactacgctatggacgtctggggccaaggggccacggtcaccgtctcctca

SEQ ID NO: 1940 - DNA, 324 bp, Homo sapiens
gacatccagatgacccagtctccatcctccctgtctgcatctgtaggagacagagtcaccatcacttgccgggcaagtcagggcattagaaatgatttagcctggtatcagcagaaaccagggaaagcccctgagcgcctgatctatgctgcatccagtttgcaaagtggggtcccatcaaggttcagcggcagtggatctgggacagaattcactctcacaatcagcagcctgcagcctgaagattttgcaacttattactgtctacagcataataattacccccggtacactttcggcggagggaccaaggtggagatcaaa

SEQ ID NO: 1941 - DNA, 363 bp, Homo sapiens
gaggtgcagctggtcgagtctgggggaggcttggtccagcctggcgggtccctgagactcgcctgtgcagtctctggattcaccctcagtgaccactacattgactgggtccgccaggctccagggaaggggctggagtgggttgcccgtactagagacaaggctcgcaggcataccacagaatacgccgcgtctgtgaaaggcagattcaccatctcaagagatgatgcaaagaactcagtgtttcttcaaatgaacagcctgaagaccgaggacacggccgtatatttctgtgctaggtcatattatggctacggcaactttgactcctggggccaggggaccctggtcaccgtctcttca

SEQ ID NO: 1942 - DNA, 321 bp, Homo sapiens
gacatccagatgacccagtctccatcctccctgtctgcatctgtaggagacagagtcaccatcacttgccgggcaagtcagggcgttagaaatgatttagcctggtatcagcagagaccagggaaaagccctaagcgcctgatctatgctgcatccactttgcaaagtggggtcccatcaaggttcagcggcagtggatctgggacagaattcactctcacaatcagtcgcctgcagcctgaggattttgcaacttattactgtctacagcatgatagttacccgtacacttttggccaggggaccaagctggagatcaaa

SEQ ID NO: 1943 - DNA, 378 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagggggagcaccaactacaacccctccctcaagagtcgagtcaccatatcagtagacacgtccaagaaccagttctccctgaggctgaggtctgtgaccgccgcagacacggccgtgtattactgtgcgagagagaggagtgttactatgattatttccccaatcaactgcttcgacccctggggccagggaaccctggtcaccgtctcctca

SEQ ID NO: 1944 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccaacagcttccaggaacagcccccaaactcctcatttatggtaacagcaatcggccctcaggggtccctgaccgattctctggctccaagtctggcacctcagcctccctggccatcactggactccaggctgaggatgaggctgattattactgccagtcctatgacagcagcctgagtggtcccgtggtattcggcggagggaccaagctgaccgtccta

SEQ ID NO: 1945 - DNA, 381 bp, Homo sapiens
gaagtgcagctggtggagtctgggggaggcttggtacagcctggcaggtccctgagactctcttgtgcagcctctggattcacctttgaagattatgccgtgcactgggtccggcaagctccagggaagggcctggagtgggtctcaggtagtagttggaatagtggtagcataggctatgcggactctgtgaagggccgattcatcatctccagagacaacgccaagaactccctgtatctgcaaatgaagagtctgagacctgaggacacggccttgtattactgtgcaaaactcgacgtgggtggctacgatttcgtctctggccactatgatgcttttgatatctggggccaagggacaatggtcagcgtctcttca

SEQ ID NO: 1946 - DNA, 336 bp, Homo sapiens
gatgctgtgatgactcagtctccgctctccctgcccgtcacccttggacagccggcctccatctcctgcaggtctagtcaaagcctcgtatacagtgatggaaacacctacttgaattggtttcaacagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggccgtacacttttggccaggggaccaagctggaaatcaaa

SEQ ID NO: 1947 - DNA, 381 bp, Homo sapiens
gaagtgcagctggtggagtctgggggaggcgtggtacagcctggggggtccctgagactctcctgtgcagcctctggattcacctttgatgtttatgccatgcactgggtccgtcaagctccagggaagggtctggagtgggtctctcttattagtggggatggtggtagcacatactatgcagactctctgaagggccgattcagcatctccagagacaacagcaaaaactccctgtttctgcaaatgaacagtctgagaactgaggacaccgccttgtattactgtgcaaaagatagagggggcagtggctgggacctcaactactactactacggtatggacgtctggggccaagggaccacggtcaccgtctcctca

SEQ ID NO: 1948 - DNA, 321 bp, Homo sapiens
gacatccagttgacccagtctccatccttcctgtctgcatctgtaggagacagagtcaccatcacttgccgggccagtcagggcattagcagttatttagcctggtttcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacaggttaatagttaccctctcactttcggcggagggaccaaggtggagatcaaa

SEQ ID NO: 1949 - DNA, 384 bp, Homo sapiens
caggtgcagctgcaggagtcgggcccaggactggtgaaggcctcggagaccctgtccctcagctgcactatttctggtgactccattaaatattattattggacttggattcggcagaccccagggagggggctggaatggattgggtatatatattataacggggagaccacatacaacccgtccctcgagagtcgggtcaccatatcagtagacacgtccaagaaccaactttccctgaggctgacttctatgactgttgcggacacggccgtctattactgtgcgagagtggggaggacaacggttcgcggagtcagtactacatattattatcatcccatggacgtctggggccaagggaccactgtcaccgtctcctca

SEQ ID NO: 1950 - DNA, 336 bp, Homo sapiens
caatctgtgctgagacagccgccctcggtgtctggggccccagggcagaaggtcaccatctactgcgccgggagcagttccaacatcggggcaggttatgatgtccattggtaccaacaatttccagggacggcccccaaactcctcatctactcaaagaccaatcgaccctcaggggtccctgaccgattctctggctccacgtctggcgcctctgcctccctggccataacagggctccgaagtgaggatgaggctgattattactgccagtcttatgacaacagccagactgcctatgcgattttcggcggggggaccaaggtgaccgtccta

SEQ ID NO: 1951 - DNA, 369 bp, Homo sapiens
gaagtgcagctggtggagtctgggggaggcgtggtacagcctggggggtccctgagactctcctgtgcagcctctggattcacctttgatgattatgccatgcactgggtccgtcaagctccagggaagagtctggagtgggtctctcttattattggggatggtggtggcacatactatgcagactctgtgaagggccgattcaccatctccagagacaacagcaaaaattccctttatctgcaaatgaacagtctgagaactgaggacaccgccttctattactgtgcaaaagattctagtatggttcagggatgggtatcctggttcgacccctggggccagggaaccctggtcaccgtctcctca

SEQ ID NO: 1952 - DNA, 324 bp, Homo sapiens
gacatccagatgacccagtctccatcctccctgtctacatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaatacccctccgtggacttttggccaggggaccaagctgcagatcaaa

SEQ ID NO: 1953 - DNA, 372 bp, Homo sapiens
caggtccaggtggtgcagtctggggctgaggtgaagaagcctgggtcctcggtgaaggtctcctgcaaggcttctggaggcacctccagcagctatgctatcagctgggtgcgacaggccccaggacaagggcttgagtggatgggaaggatcatccctatcctaggtacaacaaactacgcacagaagttccagggcagagtcacgattaccgcggacaaatccacgagcacagcctacatggagctgagcagcctgagatctgaggacacggccgtatattactgtgcgacgacccaggggggggactacggtgacaacctctactactttgagtactggggccagggaaccctggtcaccgtctcctca

SEQ ID NO: 1954 - DNA, 327 bp, Homo sapiens
tcctatgtgctgactcagccaccctcagtgtcagtggccccaggaaagacggccaggattacctgtgggggaaacagcattggaagtaaaagtgtgcactggtaccagcagaagccaggccaggcccctgtggtggtcatctattatgatagcgaccggccctcagggatccctgagcgattctctggctccaactctgggagcacggccaccctgaccatcagcagggtcgaagccggggatgaggccgactattactgtcaggtgtgggatagtactagtgatcgcctttatgtcttcggaactgggaccaaggtcaccgtccta

SEQ ID NO: 1955 - DNA, 390 bp, Homo sapiens
gaggtgcagctggtggagtctgggggaggcctggtccagcctggggggtccctgagactctcctgtgcagcctctgaattcaccttcagtagctataacatgaactgggtccgccaggctccagggaaggggctggagtgggtctcatccattagtagtagtagtagttacatgtactacgcagactcagtgaagggccgattcaccatctccagagacaacgccaagaactcactgtatctgcaaatgaacagcctgagagccgaggacacggctgtgtattactgtgcgaaagagcccggggggcgtaacgacattttgactggttatcgaataggtcccaactggttcgactcctggggccagggaatcctggtcaccgtctcctca

SEQ ID NO: 1956 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctggtcatttactgggcatctacccgggaatcgggggtccctgaccgattcagtggcagcgggtctgggacagatttcactctcaccatcagcagcctgcaggctgaagatgtggcagtttattactgtcagcaatattatattactccgatcaccttcggccaagggacacgactggagattaaa

SEQ ID NO: 1957 - DNA, 372 bp, Homo sapiens
gaggtgcagctggtggagtctgggggaggcttggtccagcctggggggtccctgagactctcctgtgcagcctctggattcacctttagtagctattggatgagctgggtccgccaggctccagggaagggcctggagtgggtggccaacataaaccaagatggaagtgagaagtactatgtggactctttgaagggccgattcaccatctccagagacaacgccaagaactcactgtctctgcaaatgaacagcctgagagccgaggacacggctgtgtattactgtgcgagagattatctttactatgataatagtggggggaccgaccttgactactggggccagggaaccctggtcaccgtctcctca

SEQ ID NO: 1958 - DNA, 321 bp, Homo sapiens
gacatccagatgacccagtctccatcctccctgtctgcatctgtaggagacagagtcaccatcacttgccgggcaagtcagggcgttagaaatgatttaggctggtatcagcagaaaccagggaaagcccctaagcgcctgatctatgctgtatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1959 - DNA, 384 bp, Homo sapiens; identical to SEQ ID NO: 1871

SEQ ID NO: 1960 - DNA, 324 bp, Homo sapiens
gaaattgtgttgacgcagtctccaggcaccctgtctttgtctccaggggaaagagccaccctctcctgcagggccagtcagagtgttatcagcaggtacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattattgtcagaagtatggtagttcatttccgactttcggccctgggacgaaagtggatatcaaa

SEQ ID NO: 1961 - DNA, 375 bp, Homo sapiens
cagctgcagctgcaggagtcgggcccaggactggtgacgccttcggagaccctgtccctcacctgcactgtctctggtggctccatcggcagtagtagttactactggggctggatccgccagcccccagggaaggggctggagtggattgggagtatctattatggtgggagcacctactacaatccgtccctcaagggtcgagtcaccatttccgtagacacgtccaggaaccagttctccctgaagctgagctctgtgaccgccgcagacacggctgtgtattactgtgcgagaacgggggaattagtgtggttcagggagccaatttccctcgacccctggggccagggaaccctggtcaccgtctcctca

SEQ ID NO: 1962 - DNA, 321 bp, Homo sapiens
gacatccagatgacccagtctccatcctcactgtctgcatctgtaggagacagagtcaccatcacttgtcgggcgagtcagggcatcagcaattatttagcctggtttcagcagaaaccagggaaagcccctaagtccctgatctatgctgcatccattctgcaaaatggggtcccatcaaagttcagcggcagtggatctgggacagatttcactctcaccatcagcaacctgcagcctgaagattttgcaacttattactgccaacagtataaaagttaccctctcactttcggcggagggaccaaggtggagatcaag

SEQ ID NO: 1963 - DNA, 354 bp, Homo sapiens
caggtcaccttgagggagtctggtcctgcgctggtgaaacccacacagaccctcacactgacctgcaccttctctgggttctcactcagcactagtggaataagtgtgagctggatccgtcagcccccagggaaggccctagagtggcttgcacgcattgattgggatgatgataaatactacagcacatctctggagaccaggctcaccatctccaaggacacctccaaaaaccaggtggtccttacaatgaccaacttggaccctgtggacacagccacgtattactgtgcacgggcagcagctggtattgaggactactggggccagggaaccctggtcaccgtctcctca

SEQ ID NO: 1964 - DNA, 321 bp, Homo sapiens
gacatccagatgacccagtctccatcctccctgtctgcatctataggagacagagtcaccatcacttgccgggcaagtcagagcattagcagttatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaggattttgcaacttactactgtcaacagagttacagtacccctcgaacgttcggccaagggaccaaggtagaaatcaaa

SEQ ID NO: 1965 - DNA, 393 bp, Homo sapiens
gaggtgcagctggtggagtctgggggaggcctggtcaagcctggggggtccctgagactctcctgtgcagcctctggattcaccttcagcagctatagcatgaactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagagattatccgcacgagaacgatttttggagtggttattactcctactactcctacggtatggacgtctggggccaagggaccacggtcaccgtctcctca

SEQ ID NO: 1966 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttacccgtacacttttggccaggggaccaagctggagatcaaa

SEQ ID NO: 1967 - DNA, 357 bp, Homo sapiens
cagatcaccttgaaggagtctggtcctacgctggtgaaacccacacagaccctcacgctgacctgcaccttctctgagtcgtcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacttgactacggagactatattcgatgtctggggccgtggcaccctggtcactgtctcctca

SEQ ID NO: 1968 - DNA, 327 bp, Homo sapiens
cagtctgccctgactcagcctgcctccgtgtctgggtctcctggacagtcgatcaccatctcctgcactggaaccagcagtgacgttggtgattacaactatgtctcctggtaccaacaacacccaggcaaagcccccaaactcatgatttatgatgtcagtaagaggccctcaggggtttctaaccgcttctctggctccaagtctggctacacggcctccctgaccatctctgggctccaggcagaggacgaggctgattattactgcagctcatatacaagcagcagcgtggtattcggcggagggaccaagctgaccgtccta

SEQ ID NO: 1969 - DNA, 369 bp, Homo sapiens
gaggtgcagctggtggagtctgggggaggcctggtcaagcctggggggtccctgagactctcctgtgcagcctctggattcatcttcagtagctatagcatgaactgggtccgccaggctccagggaaggggctggagtgggtctcatccattagtactagtagtagttacatatactacgcagagtcagtgaggggccgattcaccatctccagagacaacgccaagaactcactgtttctgcaaatgaacagcctgagcccggaggacacggctgtgtattactgtgcgagagaccccaccaacggttactatgattcggggagttccgactactggggccagggaaccctggtcaccgtctcctca

SEQ ID NO: 1970 - DNA, 324 bp, Homo sapiens
gaaatagtgatgacgcagtctccagccaccctgtctgtgtctccaggggaaagagccaccctctcctgtagggccagtcagagtgttagcagcaacttagcctggtaccagcagaaacctggccaggctcccaggctcctcatctatggtgcatccactagggccactggtatcccagccaggttcagtggcagtgggtctgggacagagttcactctcaccatcagcagcctgcagtctgaagatcttgcagtttattactgtcagcagtattataattggcctccctggacgttcggccaagggaccaaggtggaaatcaga

SEQ ID NO: 1971 - DNA, 384 bp, Homo sapiens
gaggtgcagctggtggagtctgggggaggcttggtacagcctggggggtccctgagactctcctgtgcagcctctggattcaccttcagtagcgacgacatgcactgggtccgccaagctacaggaaaaggtctggagtgggtctcaactattggttctgctggtgacacatactatccaggctccgtgaagggccgattcaccatctccagagaaaatgccaagaactccttgtatcttcaaatgaacagcctgagagccggggacacggctgtgtattactgtgcaagaggtgtacaactgcaacgactcgcgtcggggacttacaactactactactacatggacgtctggggcaaagggaccacggtcaccgtctcctca

SEQ ID NO: 1972 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcatagtggggtcccatcaaggttcagtggcagtggatctgggacagatttcactctcaccatcagcagtctgcaacctgaagattttgcaacttactactgtcaacagagttacagtttccctgggctcactttcggcggagggaccaaggtggagatcaaa

SEQ ID NO: 1973 - DNA, 357 bp, Homo sapiens
caggtgcagctacagcagtggggcgcaggactgttgaagccttcggagaccctgtccctcacctgcgctgtccatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaaactgacgtctgtgaccgccgcggacacggctctatattactgtgcgagaggcggtggatacaactatggagccattgactactggggccagggaaccctggtcaccgtctcctca

SEQ ID NO: 1974 - DNA, 333 bp, Homo sapiens
cagtctgtgctgactcagccaccctcagcgtctgggacccccgggcagagggtcaccatctcttgttctggaagcagctccaacatcggaattaattttgtatactggtatcaacaactcccaggaacggcccccaaactcctcatctataggaataatcagcggccctcagaggtccctgaccgattctctggctccaagtctggcacctcagcctccctggccatcagtgggctccggtccgaggatgaggctgattattactgtgcagcatgggatgacagcctgagtgcccatgtggtattcggcggagggaccaagctgaccgtccta

SEQ ID NO: 1975 - DNA, 378 bp, Homo sapiens
cagctgcagctgcaggagtcgggcccaggactggtgaagccttcggagaccctgtccctcacctgcactgtctctggtggctccatcagcagtagtacttactattggggctggatccgccagcccccagggaaggggctggagtggattgcgagtatctattatagtgggggcacctactacaacccgtccctcaagagtcgagtcaccatatccgtagacacgtccaagaaccagtactccctgaagctgagctctgtgaccgccgcagacacggctgtgtattactgtgcgagactgcccgatttttggagtggaagggcaggctactactacatggacttctggggcaaagggaccacggtcaccgtctcctca

SEQ ID NO: 1976 - DNA, 330 bp, Homo sapiens
gacatccagatgacccagtctccatcctccctgtctgcatctgtaggagacagagtcaccatcacttgccgggcgagtcagggcattagcaattatttagcctggtatcagcagaaaccagggaaagttcctaaactcctgatctatgctgcatccactttgcaatcaggggtcccatcgcggttcagtggcagtggatctgggacagatttcactctcatcatcagcagcctgcagcctgaagatgttgcaacttattactgtcaaaagtatagcagtgcccccccccttacgtggacgttcggccaagggaccaaggtggaaatcaaa

SEQ ID NO: 1977 - DNA, 375 bp, Homo sapiens
caggtgcagctggtgcaatctgggtctgagttgaagaagcctggggcctcagtgaaggtttcctgcaagacttctggatacaccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcagcagcctaaaggctgaggacactgccctgtattactgtgcgaagacacttcctacccgtaatttggtggctcgtggagatgctcttgatatctggggccaagggacaatggtcaccgtctcttca

SEQ ID NO: 1978 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattcagcgttcggccaagggaccaaggtggaaatcaaa

SEQ ID NO: 1979 - DNA, 372 bp, Homo sapiens
caggtgcagctgcaggagtcgggcccaggaccggtgaagccttcggagaccctgtccctcttttgcagtgtctcgggtggctccatcaacagttaccactggaactggctccggcagtccccagggaagggactggaatggataggacatgtctattatactgggaccaccaagtacaacccctcccttaagagtcgagtcaccatttcaatagacacctccaagagccaattctccctgaggttaagctctgtgaccgctgcggacacggccgtctattattgtgcgagaggcgggggagatgtcagcagctggtccttctactactacatggacgtctggggcaaagggacctcggtcaccgtctcctca

SEQ ID NO: 1980 - DNA, 324 bp, Homo sapiens
gtcatcgtgatgacccagtctccagactccctggctgtgtctctgggcgagagggccactatcaattgcaagtccagccagagtgttttatacagctccttagcttggtaccagcagaaaccaggacagcctcctaagctgctcatttactggacatctacccgggaatccggggtccctgaccgattcagtggcagcgggtctgggacagatttcactctcaccatcagcagcctgcaggctgaagacgtggcattttattactgtcagcaatattttagtactccgatcaccttcggccaagggacacgactggagattaaa

SEQ ID NO: 1981 - DNA, 360 bp, Homo sapiens
gaggtgcagctggtggagtctgggggaggcttggtacagcctggggggtccctgagactctcctgtgcagcctctggattcaccttcagcaactacgacatgcactgggtccgccaaggtacaggaacaggtctggagtgggtctcagttattggtactgctggtgacacatattatccagactccgtgaagggccgattcaccatctccagagaaaatgccaagaactccttgtatcttcaaataaaaagcctgagagccggggacacggctgtgtattactgtgcaagagcggagtaccaactgctatacggttatatggacgtctggggcaaagggaccacggtcaccgtctcctca

SEQ ID NO: 1982 - DNA, 324 bp, Homo sapiens
gacatccagatgacccagtctccatcctccctgtctgcatctgtaggagacagagtcaccatcacttgccgggcaagtcagagcattagcaactatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgctcactttcggcggagggaccaaggtggagatcaag

SEQ ID NO: 1983 - DNA, 372 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattggtggtagtggtggtagcacatactacgcagactccgtgaagggccggttcaccatctccagagacaattccaagaacacgctgtatctgcaaatgaacagcctgagagccgaagacacggccatatattactgtgtgaaaaatgagcgtatgactatgatagtagtggttaccctctttgactactggggccagggaaccctggtcaccgtctcctca

SEQ ID NO: 1984 - DNA, 330 bp, Homo sapiens
cagtctgtgttgacgcagccgccctcagtgtctgcggccccaggacagaaggtcaccatctcctgctctggaaacaactccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgaatgctgtggttttcggcggagggaccaagctgaccgtccta

SEQ ID NO: 1985 - DNA, 357 bp, Homo sapiens
caggtgcagctggtggagtctgggggaggcttggtcaagcctggagggtccctgagactctcctgtgcagcctctggattcaccttcagtgactactacatgagttggatccgccaggctccagggaaggggctggactgggtttcatacatcagtagcagtggttataccatatactacgcagactctgtgaagggccgattcaccatctccagggacaacgccaagaactcactgtatctgcaaatgaacagcctgagagccgaggacacggccgtgtattactgtgcgaggtttctcccgagtggtctctaccttgactactggggccagggaaccctggtcaccgtctcctca

SEQ ID NO: 1986 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacaacaatcggccctcaggggtccctgaccgattctctggctccaagtctggcacctcagcctccctggccatcactgggctccaggctgaggatgaggctgattattactgccagtcctatgacagcagcctgagtgcgtggggggtattcggcggagggaccaagctgaccgtccta

SEQ ID NO: 1987 - DNA, 366 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaaggggttgagtggatgggaggttttgaccctgaagatgttgaaacaatctacgcacagaggttccagggcagagtcaccatgaccgaggacacatctacagacacagcctacatggagctgagcagcctgagatctgaggacacggccgtgtattactgtgcaacagttccagccgcgataactggaactacttttgtctggtactggggccagggaaccctggtcaccgtctcctca

SEQ ID NO: 1988 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgtagcatgggatgacagcctgaatggttgggtgttcggcggagggaccaagctgaccgtccta

SEQ ID NO: 1989 - DNA, 387 bp, Homo sapiens
gaggtgcagctggtggagtctgggggaggtgtggtacggcctggggggtccctgagactctcctgtgcagcctctggattcatctttgatgattatgacatgacctgggtccgccaagctccagggaaggggctggagtgggtctctggtattagttggaatggtggtaacacaggttatgcagactctgtgaagggccgattcaccatctccagagacaacgccaagaactccctgtatctgcaaatgaacagtctgagagccgaggacacggccttgtatcactgtgcagtgattatgtctccaatcccccgttatagtggctacgattgggcgggtggtgcttttgatatctggggccaagggacaatggtcaccgtctcttca

SEQ ID NO: 1990 - DNA, 324 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggtccctatacttgtcatctatgataaaaacaaccggccctcagggatcccagaccgattctctggctccagctcaggaaacacagcttccttgaccatcactggggctcaggcggaagatgaggctgactattactgtaactcccgggacagcagtggtaacgccgtggtgttcggcggagggaccaagctgaccgtccta

SEQ ID NO: 1991 - DNA, 351 bp, Homo sapiens
caggtgcagctggtggagtctgggggaggcttggtcaagcctggagggtccctgagactctcctgtgcagcctctggattcagcttcagtgactactacatgagctggatccgccaggctccagggaaggggctggagtgggtttcatacatgagtagtagtggtagaaccatatactacgcaaactctgtgaagggccgcttcaccatctccagggacaacgccaagaactcactgtatctgcaaatgaacagcctgagagccgaggacacggccgtgtatttctgtgcgagagatggattgagaccccctgactactggggccagggaaccccggtcaccgtctcctca

SEQ ID NO: 1992 - DNA, 330 bp, Homo sapiens
cagtctgccctgactcagcctgcctccgtgtctgggtctcctggacattcgatcgccatctcctgcactggaaccagcagtgatgttgggagttataaccttgtctcctggtaccaacagcacccaggcaaagcccccaaactcatgatctatgaggccactaagcggcccgcaggggtttctaatcgcttctctggctccaagtctggcaacacggcctccctgacaatctctgggctccaggctgaggacgaggctgattattactgctgctcatatgcaggtagtagcacttatgtcttcggaactgggaccaaggtcaccgtccta

SEQ ID NO: 1993 - DNA, 363 bp, Homo sapiens
caggtcaccttgaaggagtctggtcctgtgctggtgaaacccacagagaccctcacgctgacctgcaccgtctctgggttctcactcatcaatgctaaaatgggtgtgagctggatccgtcagcccccagggaaggccctggagtggcttgcaaacattttttcgggtgacgaaaaatcgtacagcacatctctgaagagcaggctcaccatctccaaggacacctccaaaagccaggtggtccttaccatgaccaacatggaccctgtggacacagccacatatttctgtgcacggacttggtggttgtcgtcctactacatggacgtctggggcaaagggaccacggtcaccgtctcctca

SEQ ID NO: 1994 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaaactcctgatctatgctgcatccagtttgcaaagtggggtcccatcaaggttcagcggcagtggatctgggacagatttcactctcaccatcagcggcctgcagcctgaagattttgcaacttactattgtcaacagactaacagtttcccgatcaccttcggccaagggacacgactggagattaaa

SEQ ID NO: 1995 - DNA, 372 bp, Homo sapiens
caggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatttcatatgatggaagcaataaatactacgcagactccgtgaagggccgattcaccatctccagagacaattccaagaacacgctgtatctgcaaatgaacaccctgagagctgaggacacggctgtgtattactgtgcgagagattgggcacctgcatattacgatatggcgagtgcgtttgatatgtggggtcaagggacaatggtcaccgtctcttca

SEQ ID NO: 1996 - DNA, 327 bp, Homo sapiens
tcctatgtgctgactcagccaccctcggtgtcagtggccccaggaaagacggccaggattacctgtgggggaaacaacattggaggtaaaagtgtgtactggtaccagcagaagccaggccaggcccctgtgctggtcgtctatgatgataccgaccggccctcagggatccctgagcgattctctggctccaactctgggaacacggccaccctgaccatcagcagggtcgaagccggggatgaggccgactattactgtcaagtgtgggatagtagtagtgatcatccgggggtgttcggcggagggaccaagctgaccgtccta

SEQ ID NO: 1997 - DNA, 384 bp, Homo sapiens
caggtgcagctggtggagtctgggggaggcgtggtccagcctgggaggtccctgagactctcctgtgcagcgtctggactcaccttcagtagttttggcatgcactgggtccgccaggctccaggcaaggggctggagtgggtggcagttatatggtatgatggaagtaataaatactatgcagactccgtgaagggccgattcaccatctccagagacaattccaagaacacgctgtatttgcaaatgaacagtctgagagccgaggacacggctgtgtattactgtgcgagtacccaggattactatgatagtagtggttataccctatcctactacggtatggacgtctggggccaagggaccacggtcaccgtctcctca

SEQ ID NO: 1998 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctagtcatctatcaagatagcaagcggccctcagggatccctgagcgattctctggctccaactctgggaacacagccactctgaccatcagcgggacccaggctatggatgaggctgactattactgtcaggcgtgggacagcagcacttatgtcttcggagctgggaccaaggtcaccgtccta

SEQ ID NO: 1999 - DNA, 384 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcatttattagtggtacaggtggtagcacatactacgcagactccgtgaagggccggttcaccatctccagagacaactccaagaacaccctatatctgcaaatgaacagcctgagagccgaggacacggccgtatattcctgtgcgaaagatggggatctccctaccaaatattttgactggttaccggcgtactattttgactactggggccagggaaccctggtcaccgtctcctca

SEQ ID NO: 2000 - DNA, 333 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttctgctgtgttcggaggaggcacccagctgaccgtcctc

SEQ ID NO: 2001 - DNA, 381 bp, Homo sapiens
caggtgcagctggtgcagtctggggctgaggtgaagaagcctggggcctcagtgaaggtttcctgcaaggcatctggagacaccttcaccagctactatttgcactgggtgcgacaggcccctggacaagggcttgagtggatgggaataatcaaccctagtggtggtagcacaagttacgcacagaagttccagggcagagtcaccatgaccagggacacgtccacgagcacagtctacatggagctgagcagcctgagatctgaggacacggccgtgtattactgtgcgaggatagccgatggcgcttgggacgagtgggagccgactactcatccgggtgactactggggccagggaaccctggtcaccgtctcctca

SEQ ID NO: 2002 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagagaccaggacagcctcctgagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcctccaacgttcggccaagggaccaaggtggaaatcaaa

SEQ ID NO: 2003 - DNA, 375 bp, Homo sapiens
caggtgcagctggtgcaatctgggtctgagttgaagaagcctggggcctcagtgaaggtttcctgcaaggcttctggatacaccttcactaggtctgcaatgaactgggtgcgacaggcccctggacaagggcttgagtggatgggatggatcaacaccaatactgggaacccaacgtatgcccaggacttcacaggacggtttgtcttctccttggacacctctgtcagcacggcatatctgcagatcagcagcctaaaggctgaggacactgccgtgtattactgtgcgagagatcgcaattccggataccccgactactactactactacatggacgtctggggcaaagggaccacggtcaccgtctcctca

SEQ ID NO: 2004 - DNA, 336 bp, Homo sapiens
gatattgtgatgacccagactccactctctctgtccgtcacccctggacagccggcctccatctcctgcaagtctagtcagagcctcctgcatagtgatggaaagacatatttgtattggtacctgcagaaggcaggccagtctccacagctcctaatgtatgaagtttccagccgattctctggagtgccagatagattcagtggcagcgggtcagggacagatttcacactgaaaatcagccgggtggaggctgaggatgttggagtttattactgcatgcaaagtatagactctcccctcactttcggcggagggaccaaggtagagatcaaa

SEQ ID NO: 2005 - DNA, 384 bp, Homo sapiens
caggtgcagctggtggagtctgggggaggcgtggtccagcctgggaggtccctgagactctcctgtgcagcgtctggattcaccttcagtagttatggcatgcactgggtccgccaggctccaggcaaggggctggagtgggtggcacttatatggtatgatggaagtaataaatactatgcagactccgtgaagggccgattcaccatctccagagacaattccaagaacacgctgtatctgcaaatgagcagcctgagagccgaggacacggctgtgtattactgtgcgagagatcgcaacatagattaccctggttcggggacttatctccggttcggtatggacgtctggggcctagggaccacggtcaccgcctcctca

SEQ ID NO: 2006 - DNA, 321 bp, Homo sapiens
gacatccagatgacccagtctccatcttccgtgtctgcatctgtaggagacagagtcaccatcacttgtcgggcgagtcagggtattttcagctggttagcctggtatcagcagaaaccagggaaagcccctaacctcctgatctatgctgcatccactttgcaaaatggggtcccatcaaggttcagcggcagtggatctgggacagatttcactctcaccatcagcaacctgcagcctgaagattttgcaacttactattgtcaacaggctaacggtccccccctcactttcggcggagggaccaaggtggagatcaaa

SEQ ID NO: 2007 - DNA, 366 bp, Homo sapiens
gaggtgcaggtggtggagtctgggggaggcctggtcaagcctggggggtccctgagactctcctgtgcagcctctggattcaccttcaatagctatgccatgaactgggtccgccaggctccagggaaggggctggagtgggtctcatctattagtagtagtggtacttacatatactacgcagactcagtgaagggccgattcaccatctccagagacaacgccaagaactcactgtatctgcaaatgaacagcctgagagccgaggacacggctgtgtattactgttcgagtgctacggtggtaactggggggatcttgggatttgactactggggccagggaaccctggtcaccgtctcctca

SEQ ID NO: 2008 - DNA, 324 bp, Homo sapiens
tcctatgagctgacacagccaccctcggtgtcagtgtccccaggacagacggccaggatcacctgctctggagatgcattgccaaaccaatatgctttttggtaccagcagaagccaggccaggcccctgtgatggtgatatataaagacagtgagaggccctcagggatccctgagcgattctctggctacagctcagggacaatagtcacgttgaccatcagtggagtccaggcagaagacgaggctgagtattactgtcaatcagcagacagcagtggtactaatgtggtattcggcggagggaccaagctgaccgtccta

SEQ ID NO: 2009 - DNA, 360 bp, Homo sapiens
caggtgcagctggtgcagtctggggctgaggtgaaaaagcctggggcctcagtgaaggtctcctgcaaggcttctggatacaccttcaccacttatgatatcaactgggtgcgacaggccactggacaggggcttgagtggatgggatggatgaaccctaacagtggttacacagactctgcacagaagttccagggcagagtcaccatgaccaggaacacctccataagcacagcctacatggagctgagcagcctgagatctgaggacacggccgtgtattactgtgcgagtggccggggagttaaaacttactactttgactactggggccagggaaccctggtcaccgtctcctca

SEQ ID NO: 2010 - DNA, 318 bp, Homo sapiens
tcctatgagctgactcagccaccctcagtgtccgtgtccccaggacagacagccagcatcacctgctctggagataagttgggggataaatctgcttgctggtatcagcagaagccaggccagtcccctgtgttggtcatctgtcaagataccaagcggccctcaggcatccctgagcgattctctggctccaactctgggaacacagccactctgaccatcagcgggacccaggctatggatgaggccgactattactgtcaggcgtgggacagccgcactgtggtattcggcggagggaccaagctgaccgtccta

SEQ ID NO: 2011 - DNA, 357 bp, Homo sapiens
gaggtgcagctggtgcagtctggagcagaggtgaaaaagcccggggagtctctgaagatctcctgtaaggcttctggacacagctttaccacctactggatcggctgggtgcgccagatgcccgggaaaggcctggagtggatgggaatcatctatcctggtgactctgataccagatacagcccgtccttccaaggccaggtcaccatctcagccgacaagtccatcaccaccgcctacctgcagtggaacagcctgaaggcctcggacaccgccatgtattactgtgcgagaacccctacgctgtacaactggttcgacccctggggccagggaaccctggtcaccgtctcctca

SEQ ID NO: 2012 - DNA, 333 bp, Homo sapiens
cagtctgtgctgactcagccaccctcagcgtctgggacccccgggcagagggtcaccatctcttgttctggaagcagctccaacatcggaagtaatagtgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcatgaatggttcttgggtgtttggcggagggaccaagctgaccgtccta

SEQ ID NO: 2013 - DNA, 351 bp, Homo sapiens
caggtgcagctggtgcagtctggggctgaggtgaagaagcctgggtcctcggtgaaggtctcctgcaaggcttctggaggcaccttcagtagctatgctatcagctgggtgcgacaagcccctggacaagggcttgagtggatgggagggatcatccctatctttggtacagcaaactacgcacagaagttccagggcagagtcaccattaccgcggacgaatccaccagaacagcctacatggagctgagcagcctgagatctgaggacacggccgtctattattgtgcgagggaggaggggtttcatagtagtgtctggggccagggaaccctggtcaccgtctcctca

SEQ ID NO: 2014 - DNA, 327 bp, Homo sapiens
gaaattgtgttgacacagtctccagccaccctgtctttgtctccagggggaagagccaccctctcctgcagggccagtcagagtgttagcagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaggattttgcagtttattattgtcagcagcgtagcaactggcctccgaggatcactttcggcggagggaccaaggtggagatcaaa

SEQ ID NO: 2015 - DNA, 375 bp, Homo sapiens
gaagtgcagctggtggagtctgggggaggcttggtacagcctggcaggtccctgacactctcctgtgcaggctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctatatctgcaaatgaacagtctgagagctgaggacacggccttgtattactgtgcaaaagatgtctcctatgatagtagtggttattacaacaatgcttttgatatctggggccaagggacaatggtcaccgtctcttca

SEQ ID NO: 2016 - DNA, 321 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaataagcagcctgcagcctgaagattttgcaacttattactgtcaacaactttatagttacccggtcaccttcggccaagggacacgactggagattaaa

SEQ ID NO: 2017 - DNA, 375 bp, Homo sapiens
caggtgcagctggtgcaatctgggtctgagttgaagaagcctggggcctcagtgaaggtttcctgcaaggcttctggatactccttcactagctatgctatgaattgggtgcgacaggcccctggacaagggcttgagtggatgggatggatcaacaccaacactgggaacccaacgtatgcccagggcttcacaggacggtttgtcttctccttggacacctctgtcagcacggcatatctgcagatcaccagcctaaaggctgaggacactgccgtgtattactgtgcgagagattgggaggtaccagccccctactactcctactactacatggacgtctggggcaaagggaccacggtcaccgtctcctca

SEQ ID NO: 2018 - DNA, 336 bp, Homo sapiens
gacattgtgatgacccagactccactctctctgtccgtcacccctggacagccggcctccatctcctgcaagtctagtcagagcctcctgcatagtgatggaaagacctatttgtattggtacctgcagaagtcaggccagtctccacagctcctgatctatgaaatttccgaccggttctctggagtgccagataggttcagtggcagcgggtcagggacaaatttcacactgaaaatcagccgggtggaggctgaggatgttggggtttattactgcatgcaaagtatacagcttccgtacacttttggccaggggaccaagctggagatcaaa

SEQ ID NO: 2019 - DNA, 348 bp, Homo sapiens
gaggtgcagttggtggagtctgggggaggtgtggtacggcctggggggtccctgagactctcctgtgcagcctctggattcacctttgatgattatggcatgagctgggtccgccaagctccagggaaggggctggagtgggtctctggtattaattggaatggtggtagcacaggttatgcagactctgtgaagggccgattcaccatctccagagacaacgccaagaactccctgtatctgcaaatgaacagtctgagagccgaggacacggccttgtatcactgtgcgagaggtgatacgatatttggggcctggggccagggaaccctggtcaccgtctcctca

SEQ ID NO: 2020 - DNA, 339 bp, Homo sapiens
gacatcgtgatgacccagtctccagactccctggctgtgtctctgggcgagagggccaccatcaactgcaagtccagccagagtgttttatacagtttcagcaataagaactacttagcttggtaccagcagaaactaggacagcctcctaagctcctcatttactgggcatctacccgggaatccggggtccctgaccgattcggtggcagcgggtctgggacagatttcactctcaccatcagcagcctgcaggctgaagatgtggcagtttattactgtcagcaatattatagtactccgtggacgttcggccaagggaccaaggtggaaatcaaa

SEQ ID NO: 2021 - DNA, 372 bp, Homo sapiens
caggtccagcttgtgcagtctggggctgaggtgaagaagcctggggcctcagtgaaggtttcctgcaaggcttctggatacaccttcactagctatgctatgcactgggtgcgccaggcccccggacaaaggcttgactggatgggatggatcaacgctggcaatggtaacacaaaatattcacagaagttccaggacagagtcaccattaccagggacacatccgcgagcacagcctacatggagctgagcagcctgagatctgaagacacggctgtctattactgtgcggtaccacgtggatatagtggctacgattacgagggggcctttgactactggggccagggaaccctggtcaccgtctcctca

SEQ ID NO: 2022 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctgagctcctcatctacgatgcattcaatttggaaataggggtcccggcaaggttcagtggaagtggatctgggacagattttactttcaccatcagcagcctgcagcctgaagatattgcaacatattactgtcaacagtatgataatctccctctcactttcggcggagggaccaaggtggagatcaaa

SEQ ID NO: 2023 - DNA, 369 bp, Homo sapiens
gaagtgcagctggtggagtctgggggagtcgtggtacagcctggggggtccctgagactctcctgtgcagcctctggattcagctttgatgattataccatgcactgggtccgtcaagctccggggaagggtctggagtgggtctcttttgttagttgggatggtggtagcacatactatgcagactctgtgaagggccgattcaccatctccagagacaagagcaaaaactccctgtatctgcaaatgaacagtctgagaactgaggacaccgccttgtattactgtgcaagagaggatagtagtggttacccctctgtgtcctactttgactactggggccagggaaccctggtcaccgtctcctca

SEQ ID NO: 2024 - DNA, 324 bp, Homo sapiens
ggcatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcaacagcctgcagcctgaagattttgcagcttattactgtcaacaggttaatagttaccccgagctcactttcggcggagggaccaaggtggagatcaaa

SEQ ID NO: 2025 - DNA, 375 bp, Homo sapiens
caggtgcagctgcaggagtcgggcccaggactggtgaagccttcagagaccctgtccctcacctgcactgtctctggtgcctccatcagcagtggtaagaaccactggagttggatccggcagcccgccgggcagggactggagtggattggacgtatgactaccggtgtgactaccggtggcattaccgcctacaaatcttccctcaagagtcgagtcaccatctcactagacacgtccaggaaccaattctccctgagcctgagctctgtgaccgccgcagacacggccgtctattactgtgcgagagatcccgtcgatggtaacagtttctttgactcctggggccaggggaccctggtcaccgtctcctca

SEQ ID NO: 2026 - DNA, 333 bp, Homo sapiens
gaaattgtgttgacgcagtctccaggcaccctgtctttgtctctaggagaaagaggcacgctctcctgcagggccagtcagagtgtagacagccgctacttagactggtatcaacagagacctggccaggctcccaggctcgtcatctatggtgcatccaccagggccactggcatcccagacaggttcagtggcagcgggtctgggacagacttcactctcaccatcagcagactggagcctgaagattttgcagtgtattactgtcagtactatattaactcaacacctccgcagcacacttttggccaggggaccaaggtggagatcaaa

SEQ ID NO: 2027 - DNA, 366 bp, Homo sapiens
caggtccagctggtacagtctggggctgaggtaaagaagcctggggcctcagtgaaggtctcctgcaaggtttccggatacaccctcattgaattatccatgcactgggtgcgacaggctcctggaaaagggcttgagtggatgggaggttttgatcctgaagaagctgaaacattctacgcacagaagttccagggcagagtcaccatgaccgaggacacatctacagacacagcctacatggagctgagcagcctgagttctgaggacacggccgtgtattactgtgcaacagttccagccgcgataggtggaactgcttttgtctggtactggggccagggaaccctggtcaccgtctcctca

SEQ ID NO: 2028 - DNA, 330 bp, Homo sapiens
cagtctgtgctgactcagccaccctcagcgtctgggacccccgggcagagggtcaccatctcttgttctggaagcagctccaacatcggaagtagtactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgagtattactgtgcagcatgggatgacagcctgaatggttgggtgttcggcggagggaccaagctgaccgtccta

SEQ ID NO: 2029 - DNA, 363 bp, Homo sapiens
caggtgcagctgcaggagtcgggcccaggactggtgaagccttcacagaccctgtccctcacctgcactgtctctggtggctctagcagcagtggtggttactactggagttggatccgccagcccccagggaagggcctggagtggattgggtacatctataacagtgggagcacctaccacaacccgtcactcaagagtcgagttaccatatcagtagacacgtccaagaaccagttctccctgaaggtgagctctgtgactgccgcagacacggccgtgtattactgtgccaggatgaatacggtgactacgtggtactttgactactggggccagggaaccctggtcaccgtctcctca

SEQ ID NO: 2030 - DNA, 324 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctgggtgttcggcggagggaccaagctgaccgtccta

SEQ ID NO: 2031 - DNA, 384 bp, Homo sapiens
gaggtgcagctgttggagtctgggggaggcttggtacagcctggggggtccctgagactctcctgtgcagcctctggattcacctttagcatctatgccatgagctgggtccgccaggctccagggaagggactggagtgggtctcacttcttagtagtagtggtggtagcacatactacgcagactccgtgaagggccggttcaccatctccagagacaattccaagaacacgctgtatctgcaaatgaacagcctgagagccgaggacacggccgtatattactgtgcgaaagacgggggcggtagttggtcccccgttcattactactactactacgctatggacgtctggggccaagggaccacggtcaccgtctcctca

SEQ ID NO: 2032 - DNA, 336 bp, Homo sapiens
cagtctgccctgactcagcctgcctccgtgtctgggtctcctggacagtcgatcaccatctcctgcactggaaccagcaatgatgttgggagttataaccttgtctcctggtaccaacaacacccaggcaaagcccccaaactcatgatttatgaggtcactaagcggccctcaggggtttctaatcgcttctctggctccaagtctggcaacacggcctccctgacaatctctgggctccaggctgaggacgaggctgattattactgctgctcatatgcaggtagtagcacttcctatgtgcttttcggcggagggaccaagctgaccgtccta

SEQ ID NO: 2033 - DNA, 384 bp, Homo sapiens
gaggtgcagctggtggagtctgggggaggcctggtcaagcctggggggtccctgagactctcctgtgcagcctctggattcaccttcagtaactataacatgaactgggtccgccaggctccagggaaggggctggagtgggtctcatccattagtagtcgtagtaattacatatactacgcaggctcagtgaagggccgattcaccatctccagagacaacgccaagaactcactgtatctgcaaatgaacagcctgagagccgaggacacggctgtgtattactgtgcgagagctggtaacacgtattacggtattttgactgattattacccggatgcttttgatatgtggggccaagggacaatggtcaccgtctcctca

SEQ ID NO: 2034 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcaatttattactgtcagcagtatcataactggcctccgtggacgttcggccaagggaccaaggtggaaatcaaa

SEQ ID NO: 2035 - DNA, 384 bp, Homo sapiens
caaatgcagctggtgcagtctgggcctgagatgaagaagcctgggacctcagtgaaggtctcctgcaaggcttctggattcacctttactagctctgctattcagtgggtgcgacaggctcgtggacaacgccttgagtgggtaggatggatcgtcgttggcagtgatgtcacaaactacgcacagaagttccaggaaagagtcaccattaccagggacatgtccacaagcacagcctacatggagctgagaagcctgagatccgaggacacggccgtgtattactgtgcggcagatcgggaatattgtactaatggtgtctgccgacaaaattactactacatggacgtctggggcaaagggaccacggtcaccgtctcctca

SEQ ID NO: 2036 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcaggagacgaggctgactatttctgtcaatcagctgacagcagtgctacctatgtaatgttcggcggagggaccaagctgaccgtccta

SEQ ID NO: 2037 - DNA, 369 bp, Homo sapiens
caggtgcagctggtgcagtctggggctgaggtgaagaagcctggggcctcagtgaaggtttcctgcaaggcatctggaaacaccttcagtagttactatatgcactgggtgcgacaggcccctggacaagggcttgagtggatgggaataatcaatcttagtggtggtagcacacgttacgcacagaagttccagggcagtgtcaccatgaccagggacacgtccacgagcacagtctacatggagctgagcagcctgagatctgaggacacggccgtgtattactgtgcgaccgaggcccacattgtagtagtaccagctgccccctttgactactggggccagggaaccctggtaatcgtctcctca

SEQ ID NO: 2038 - DNA, 327 bp, Homo sapiens
gaaattgtgttgacacagtctccagccaccctgtctttgtctccaggggaaagagccaccctctcctgcagggccagtcagagtgttagcagctacttagcctggtaccagcagaaacctggccaggctcccaggctcctcatctatgatgtatccaacagggccactggcatcccagccaggttcagtggcagtgggtctgggacagacttcactctcaccatcagcagcctagagcctgaagattttgcagtttattactgtcagcagcgtagcaactggcctcccacgtacacttttggccaggggaccaagctggagatcaaa

SEQ ID NO: 2039 - DNA, 378 bp, Homo sapiens
caggtgcagctggtggagtctgggggaggcgtggtccagcctgggaggtccctgagactctcctgtgcagcctctggattcaccttcagtcgctatggcatgcactgggtccgccaggctccaggcaaggggctggagtgggtggcagttatgtcatatgatggaagtaataaatactatgcagactccgtgaagggccgattcaccatctccagagacaattccaagaacacgctgtatctgcaaatgaacagcctgaaagctgaggacacggctgtgtattactgtgcgaaaaaaggtgccccatattgtggtattgactgctatcgaggctactttgactactggggccagggaaccctggtcaccgtctcctca

SEQ ID NO: 2040 - DNA, 321 bp, Homo sapiens
gacatccagatgacccagtctccatcctccctgtctgcatctgtaggagacagagtcaccatcacttgccaggcgagtcaggacattaccaactatttaaattggtatcagcagaaaccagggaaagcccctaagctcctgatctacgatgcatctaatttggaaacaggggtcccatcaaggttcagtggaagtggatctgggacagattttactttcaccatcagcagcctgcagcctgaagacattgcaacatattactgtcaacagtatgataatctcccgctcactttcggcggagggacaaaggtggagatcaaa

SEQ ID NO: 2041 - DNA, 381 bp, Homo sapiens
caggtgcagctggtggagtctgggggaggcgtggtccagcctgggaggtccctgagactctcctgtgcagcctctggattcagcttcagtaactatggcatgcactgggtccgccaggctccaggcaaggggctggagtgggtggcagttatatcatatggtggaagtgataaatactatgcagactccgtgaagggccgattcaccatctccagagacacttccaagaacacgctatatctgcaaatgaacagcctgagagctgaggacacggctgtgtattactgtgcgaaagcctaccggggggatttgattacgtttgggggagtcatcgcgccccttgactactggggccagggaaccctggtcaccgtctcctca

SEQ ID NO: 2042 - DNA, 333 bp, Homo sapiens
cagtctgtgctgacgcagccgccctcagtgtctggggccccagggcagagggtcaccttctcctgcactgggagcagctccaacatcggggcaggttatgatgtatactggtaccagcagcttccaggaacagcccccaaactcctcatttatggtaacaccaatcggccctcaggggtccctgaccgattctctggctccaagtctggcacctcagcctccctggccatcactgggctccaggctgaggatgaggctgattattactgccagtcctatgacagcagcctgagtgtcttggtcttcggaactgggaccaaggtcaccgtccta

SEQ ID NO: 2043 - DNA, 354 bp, Homo sapiens
caggtgcagctggtgcaatctgggtctgagttgaagaagcctggggcctcagtgaaggtttcctgcaaggcttctggatacaccttcactaactatgctatgaattgggtgcgacaggcccctggacaagggcttgagtggatgggatggatctacaccaacactgggaacccaacgtatgcccagggcttcacaggacggtttgtcttctccttggacacctctgtcagcacggcatatttgcagatcagtagcctaaaggctgaggacactgccgtgtattactgtgcgagagagttcgtcggctggaactttgactactggggccagggaaccctagtcaccgtctcctca

SEQ ID NO: 2044 - DNA, 324 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagatcaggaaacacagcttccttgaccatcactggggctcaggcggaagatgaggctgactattactgtaactcccgggacaacaatggtaacgcttgggtgttcggcggagggaccaagttgaccgtccga

SEQ ID NO: 2045 - DNA, 372 bp, Homo sapiens
cagctgcagctgcaggagtcgggcccaggactggtgaagccttcggagaccctgtccctcacctgcactgtctctggtggctccatcagcagtagtagttactactggggctgggtccgccagcccccagggaaggggctggagtggattgggaatatctattatagtgggagcacctactacaacccgtccctcaagagtcgagtcaccatatccgtagacacgtccaagaaccagttctccctgaagctgagctctgtgaccgccgcagacacggctgtgtattactgtgcgagagacggggccgaatttacggtgacggggtacgctatggacgtctggggccaagggaccacggtcaccgtctcctca

SEQ ID NO: 2046 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcacgctcaccatcagcagcctgcagcctgatgattttgcaacttattactgccaacagtataatagttacccgtacacttttggccaggggaccaagctggagatcaaa

SEQ ID NO: 2047 - DNA, 369 bp, Homo sapiens
caaatgcacctggtgcagtctgggcctgaggtgaagaagcctgggacctcagtgaaggtctcctgcaaggcttctggattcacctttactagttctgctatgcagtgggtgcgacaggctcgtggacaacgccttgagtggataggatggatcgtcgttggcagtggtaacacaaactacgcacagaagttccaggaaagagtcaccattaccagggacatgtccacaagcacagcctacatggagctgagcagcctgagatccgaggacacggccgtgtattactgtgcggcacctcattgtaatagaaccagctgctatgatggttttgatatctggggccaagggacaatggtcaccgtctcttca

SEQ ID NO: 2048 - DNA, 324 bp, Homo sapiens
gaaattgtgttgacgcagtctccaggcaccctgtctttgtctccaggggaaagagccaccctctcctgcagggccagtcagagtgttagaagcagctacctagcctggtaccagcagaaacctggccaggctcccaggctcctcatctatggtgcatccagcagggccactggcatcccagacaggatcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 2049 - DNA, 396 bp, Homo sapiens
cagctgcagctgcaggggtcgggcccaggactggtgaagccttcggagaccctgtccctcacctgcactgtctctggtggctccatcagcagtagtacttactactggggctggatccgccagcccccagggaaggggctggagtggattgggactatttattatagtgggagcacctactccaacccgtccctcaagagtcgagtcaccatatccgtagacacgtccaagaaccagttctccctgaagctgagctctgtgaccgccgcagacacggctgtgtattactgtgcgagacaagtgggatatgatttcgtttgggggagttatcgttctgtcggggaaccccactactttgactgctggggccagggaaccctggtcaccgtctcctca

SEQ ID NO: 2050 - DNA, 321 bp, Homo sapiens
gacatccagatgacccagtctccttccaccctgtctgcatctgtaggggacagagtcaccataacttgccgggccagtcagagtattaatagctggttggcctggtatcaacacaaaccagggaaagcccctaagctcctgatctataaggcgtctagtttagaaagtggggtcccatcaaggttcagcggcagtggatctgggacagaattcactctcaccatcaccagcctgcagcctgatgattttgcaacttattactgccaacagtttcatacttattcgtacacttttggcctggggaccaagctggagatcaaa

SEQ ID NO: 2051 - DNA, 390 bp, Homo sapiens
caggtcaccttgagggagtctggtcctgcgctggtgaaacccacacagaccctcacactgacctgcaccttctctgggttctcactcagcaccagtggaatgtgtgtgagctggatccgtcagcccccagggaaggccctggagtggcttgcactcattggttgggatgatgataagtactacagtccatctctgaagaccaggctcaccatctccaaggacacctccaaaaaccaggtggtccttacaatgaccaacatggaccctgtggacacagccacgtattactgtgcacggacccgtcccactggatatagtggctacgatttcggttttccggaggtcttcttcgacccctggggccagggaaccctggtcaccgtctcctca

SEQ ID NO: 2052 - DNA, 321 bp, Homo sapiens
gaaatagtgatgacgcagtctccagccaccctgtctgtgtctccaggggaaagagccgccctctcctgcagggccagtcagagtgttagcagcaacttagcctggtaccagcagaaacctggccaggctcccaggctcctcatctatagtgcatccaccagggccaccggtatcccagccaggttcagtggcagtgggtctgggacatatttcactctcaccatcagcagcctgcagtctgaagattttgcagtttattactgtcagcagtataataactggcccttgacgttcggccaagggaccaaggtggaaatcaaa

SEQ ID NO: 2053 - DNA, 390 bp, Homo sapiens
caggtgcagctggtggagtctgggggaggcgtggtccagcctgggaggtccctgagactctcctgtgcagcctctggattcaccttcagtagccatgctatgcactgggtccgccaggctccaggcaaggggctggagtgggtggcagttatatcatatgatggaagtaataaacactacgcagactccgtgaagggccgattcaccatctccagagacagttccaagagcacgctgtatctgcaaatgaacaggctgagagctgaggacacggctgtgtattactgtgcgagagatcatggggtgatgggagcttttctctctcgggtctccccgtggggaggggcgtttgactcctggggccagggaaccctggtcaccgtctcctca

SEQ ID NO: 2054 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactccgtacacttttggccaggggaccaaggtggagatcaaa

SEQ ID NO: 2055 - DNA, 345 bp, Homo sapiens
gaggtgcagctggtggagtctgggggaggcttggtccagcctggggggtcccggagactctcctgtgcagcctctggattcacctttagtagctattggatgaactgggtccgccaggctccagggaaggggctggagtgggtggccaacataaaggaagatggaagtgacaaatactatgtggactctgtgaagggccgattcaccatctccagagacaactccaagaactcactgtatctgcaaatgaacagcctgagagtcgaggacacggctgtgtactactgtgcgagaggtcacgggttcgacccctggggccagggaaccctggtcaccgtctcctca

SEQ ID NO: 2056 - DNA, 324 bp, Homo sapiens
tcttctgagctgactcaggaccctgctgtgtctgtggccttgggacagacagtcaggatcacatgccaaggagacagcctcagaagctattctgcaagctggttccagcagaagccaggacaggcccctgtacttgtcatctatgttaaaaagaaccggccctcagggatcccagaccgattctccggctccagctcaggaaacacagcttccttgaccatcactggggctcaggcggaagatgaggctgactattattgtaactcccgggacaccagtggtaaccattatgtcttcggaactgggaccaaggtcaccgtccta

SEQ ID NO: 2057 - DNA, 351 bp, Homo sapiens
gaggtgcagctggtggagtctggaggaggcttgatccagcctggggggtccctgagactctcctgtgcagcctctggggtcaccgtcagtagcaactacatgacctgggtccgccaggctccagggaaggggctggagtgggtctcagttatttatagcggtggtagcacatactacgcagactccgtgaagggccgattcaccatctccagagacagttccaagaacacgctgtatcttcaaatgaacagcctgagagccgaggacacggccgtgtattactgtgcgagagatctggtctactacggtatggacgtctggggccaagggaccacggtcaccgtctcctca

SEQ ID NO: 2058 - DNA, 321 bp, Homo sapiens
gacatccagttgacccagtctccatccttcctgtctgcatctgtaggagacagagtcaccatcacttgccgggccagtcagggcattagcagttacttagcctggtatcagcaaaaaccagggaaagcccctaggctcctgatctatgctgcatccactttgcaaagtggggtcccatcaaggttcagcggcagtggatctgggacagagttcactctcacaatcagcagcctgcagcctgaagattttgcaacttattactgtcaactgcttaatagtgaccgtttcactttcggccctgggaccaaagtggatatcaaa

SEQ ID NO: 2059 - DNA, 372 bp, Homo sapiens
gaggtgcacttgttggagtctgggggaggcttggtacagcctggggggtccctgagactctcctgtgcagtctctggattcaccttcagcagctatgtcatgagctgggtccgccaggctccagggaaggggctggagtgggtctcagctattagtggtagtggtggtagtatatactacgcagactccgtgaagggccggttcaccatctccagagacaattccaagaacacgctgtatctgcaaatgaacagcctgagagccgaggacacggccgtatattactgtgcgaaagatccgagtaccagttctaattattattccttctacctggacgtctggggcaaagggaccacggtcaccgtctcctca

SEQ ID NO: 2060 - DNA, 336 bp, Homo sapiens
cagtctgccctgactcagcctgcctccgtgtctgggtctcctggacagtcgatcaccatctcctgcactggaaccagccgtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttcctatgtggtattcggcggagggaccaagctgaccgtccta

SEQ ID NO: 2061 - DNA, 360 bp, Homo sapiens
caggtgcagctggtgcagtctggggctgaggtgaagaagcctgggtcctcggtgaaggtctcctgcaaggcttctggaggcaccttcagcagctatggtgtcagctgggtgcgacaggcccctggacaagggcttgagtggatgggagggatcatccctatctttggtacagcaaactacgcacagaagttccagggcagagtcactcttaccgcggacgaatccacgagcacagcctacatggagctgagcagcctgagatctgaggacacggccgtgtattactgtgcgatatggggggatgacttagaactggaagttcactactggggccagggaaccctggtcaccgtctcctca

SEQ ID NO: 2062 - DNA, 324 bp, Homo sapiens
gaaattgtgttgacacagtctccagccaccctgtctttgtctccaggggaaagagccaccctctcctgcagggccagtcagagtattatcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcatagcaactggcctcccttcactttcggccctgggaccaaagtggatatcaaa

SEQ ID NO: 2063 - DNA, 369 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgagtcaccatatcagtagacacgtccaagcaccagttctccctgaacctgagctctgtgaccgctgcggacacggccgtgtattactgtgcgagaggtctgttggaacgcccactctactactactactacatggacgtctggggcaaagggaccacggtcaccgtctcctca

SEQ ID NO: 2064 - DNA, 330 bp, Homo sapiens
cagtctgtgctgactcagccaccctcagcgtctgggacccccgggcagagggtcaccatctcttgttctggaagcagctccaacatcggaagtaatcctgtaaactggtaccagcagctcccccgaacggcccccacactcctcatctatagtaatagtcagcggccctccggggtccccgaccgattctctggctccaagtctggcacctcagcctccctggccatcagtgggctccagtctgaggatgaggctgattattactgtgcagcctgggatgacagcctgaatggtgtggtcttcggcggagggaccaaactgaccgtccta

SEQ ID NO: 2065 - DNA, 354 bp, Homo sapiens
caggttcaattggtgcagtctggggctgaggtgaagaagcctggggcctcagtgaaggtctcctgcaagatttctggtcacagttttaccacttttggtatcagctgggtgcgacaggcccctggacaaggccttgagtggatgggatggatcagcccgtacaatgggaatacagactatgcacagaacctccagggcagaatcaccatgaccactgacacatccacgaccacagcctacatggaactgaggagcctgagatctgacgacacggccatatattattgtgcgagattacttaggggaggagcccttgcatactggggccagggaaccctggtcaccgtctcctca

SEQ ID NO: 2066 - DNA, 324 bp, Homo sapiens
gaagttgtgttgacgcagtctccaggcaccctgtctttgtctccaggggaaagagccaccctctcctgcagggccagtcagagtgttaccaacggcgacttggcctggtaccagcagaaacctggccaggctcccaggctcctcatctatggtgcatccagcagggccactgacatcccagacaggttcagtggcagtgggtctgggacagacttcactctcaccatcagtagactggagcctgatgattttgcagtgtattactgtcagcactatagtagctcacctgtaagttttggccaggggaccaagctggaaatcaaa

SEQ ID NO: 2067 - DNA, 354 bp, Homo sapiens
caggtgcagctggtggagtctgggggaggcgtggtccagcctgggaggtccctgagactctcctgtgcagcctctggattcaccttcagaagctatggcatgcactgggtccgccaggctccaggcaaggggctggagtgggtggctgttttatcatatgatggaagtaataaatactatgcagactccgtgaagggccgattcaccatctccagagacaattccaagaacacgctgtatctgcaaatgaacagcctgagagctgaggacacggctgtgtattactgtgtgaaagatgattcagtggctggaactgggtactggggccagggaacgctggtcaccgtctcctca

SEQ ID NO: 2068 - DNA, 339 bp, Homo sapiens
gacatcgtgatgacccagtctccagactccctggctgtgtctctgggcgagagggccaccatcaactgcaagtccagccagagtgttttatacagctccagcaataagaactgcttagcttggttccagcagaaaccaggacagcctcctaagctgctcatttactgggcatcttcccgggaatccggggtccctgaccgattcagtggcagcgggtctgggacagatttcactctcaccatcagcagcctgcaggctgaagatgtggcagtttattactgtcagcaatattatagtactcctcagacgttcggccaagggaccaaggtggaaatcaaa

SEQ ID NO: 2069 - DNA, 369 bp, Homo sapiens
gaagtgcagctggtggagtctgggggaggcttggtacagcctggcaggtccctgagactctcctgtgcagcctctggattcccctttaattattatgccatgcactgggtccggcaagctccagggaagggcctggagtgggtctcaggtattagttggaatagtggtaccataggctatgcggactctgtgaagggccgattcaccatctccagagacaacgccaagaactccctgtatctgcaaatgaacagtctgagagctgaggacacggccttgtattactgtgcaaaagatcgacgcccctcgggcaggtactactacggtatggacgtctggggccaagggaccacggtcaccgtctcctca

SEQ ID NO: 2070 - DNA, 330 bp, Homo sapiens
aattttatgctgactcagccccactctgtgtcggagtctccggggaagacggtaaccatctcctgcacccgcagcagtggcagcagtgccagcaactatgtgcagtggtaccagcagcgcccgggcagtgcccccaccgctgtgatctatgaggataaccaaagaccctctggggtccctgatcggttctctggctccatcgacagctcctccaactctgcctccctcaccatctctggactgaagactgaggacgaggctgactactactgtcagtcttctgatagcaccaatctggtgttcggcggagggaccaagctgaccgtccta

SEQ ID NO: 2071 - DNA, 369 bp, Homo sapiens
gaggtgcagctggtggagtctgggggaggcttggtacagcctggggggtccctgagactctcctgtgcagcctctggattcaccttcagtagctacgacatgcactgggtccgccaagttacaggaaaaggtctggagtgggtctccgctattggtacttctggtgacacatactatccaggctccgtgaagggccgattcaccatctccagagaaaatgccaagaactccttgtatcttcaaatgaacagcctgagagtcggggacacggctgtgtattactgtgctcgtgcgaattactttgatgttagtggtttttacttacacttcgatctctggggccgtggcaccctggtcactgtctcctca

SEQ ID NO: 2072 - DNA, 324 bp, Homo sapiens
gacatccagatgacccagtctccatcctccctgtctgcatctgtgggagaccgagtcaccatcacttgccgggcaagtcagatcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacactacccttgcgctcactttcggcggagggaccaaggtggagatcaaa

SEQ ID NO: 2073 - DNA, 366 bp, Homo sapiens
caggtccagctggtacaatctggggctgaggtgaagaagcctggggcctcagtgaaggtctcctgcaaggtttccggttacaccctcattgaattatccatgcactgggtgcgacaggctcctggaaaagggcttgagtggatgggaggttttgatccggaagatgttgaaacaatctacgcacagaagttccagggcagagtcaccatgaccgaggacacatctacagacacagcctacatggagctgagcagcctgagatctgaggacacggccgtgtattactgtgcaacagttccagccgcgataactggaaaaacttttgtctggtattggggccagggaaccctggtcaccgtctcctca

SEQ ID NO: 2074 - DNA, 330 bp, Homo sapiens
cagtctgtgctgactcagccaccctcagcgtctgggacccccgggcagagggtcaccatctcttgttctggaagcagctccaacatcggaaataatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgtagcatgggatgacagcctgaatggttgggtgttcggcggagggaccaagctgaccgtccta

SEQ ID NO: 2075 - DNA, 396 bp, Homo sapiens
caggtgcagctggtggagtctgggggaggcgtggtccagcctgggaggtccctgagactctcctgtgcagcctctgaattcaccttcagtagctatggcatgcactgggtccgccaggctccaggcaaggggctggagtgggtggcagttatatcacatgatggaagtaatgaatactatgcagactccgtgaagggccgattcaccatctccagagacaattccaagaacacgctgtatctgcaaatgaacagcctgagagctgaggacacggctgtgtattactgtgcgaaatggcgggggcctcataggggttactatgatagaagtggttattatttagggtccagccgcgatgactactggggccagggaaccctggtcaccgtctcctca

SEQ ID NO: 2076 - DNA, 327 bp, Homo sapiens
gacatccagatgacccagtctccatcctccctgtctgcatctgtacgagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctcctccccatattcactttcggccctgggaccacagtggatatcaaa

SEQ ID NO: 2077 - DNA, 360 bp, Homo sapiens
caggtgcagctggtgcagtctggggctgaggtgaagaagcctgggtcctcggtgaaggtctcctgcaaggcttctggaggcaccttcagtaattatgctatcaactgggtgcgactggcccctggacaagggcttgagtggatgggagggatcatccctatctttggtacagcaaactatgcacagaagttccagggcagagtcaccattaccgcggacgaatccacgagcacagcctacatggagctgagcagcctgagatctgaggacacggccgtgtattattgtgcgggagatcttggtgactacggacccccggaagactactggggccagggaaccctggtcaccgtctcctca

SEQ ID NO: 2078 - DNA, 324 bp, Homo sapiens
gaaattgtgttgacacagtctccagccaccctgtctttgtctccaggggaaagagccgccctctcctgcagggccagtcagagtgttagcaccttcttagcctggtaccaacataaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcgccgtagcaactggcctcccttcactttcggcggagggaccaaggtggagatcaaa

SEQ ID NO: 2079 - DNA, 363 bp, Homo sapiens
caggtccagctggtacaatctggggctgaggtgaagaagcctggggcctcagtgaaggtctcctgcaacgtttccggatacaccctccctgaattatccatgcactgggtgcgacaggctcctggaaaagggcttgagtggatgggaggttttgatcctgaagatggtgaaacaatctccgcacagaagttcctgggcagagtcaccatgaccgaggacacatctacagacacagcctacatggagctgagcagcctgagatctgaggacacggccgtgtattactgtgcaacagggacagctgtggttacttcatactggttcgacccctggggccagggaaccctggtcaccgtctcctca

SEQ ID NO: 2080 - DNA, 333 bp, Homo sapiens
cagtctgccctgactcagcctgcctccgtgtctgggtctcctggacagtcgatcaccatctcctgcactggaaccagcagtgacgttggtggttataactctgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctccgggtgttcggcggagggaccaagctgaccgtccta

SEQ ID NO: 2081 - DNA, 363 bp, Homo sapiens
caggtgcagctggtggagtctgggggaggcgtggtccagcctgggaggtccctgagactctcctgtgcagcctctggattcaccttcaatagctatgctatgtactggatccgccaggctccaggcaaggggctggagtgggtggcagttatatcatatgatggaagcaataaatactacgcagactccgtgaagggccgattcaccatctccagtgacaattccaagaacacgctgtatctgcaaatgaacagcctgagagctgaggacacggctgtgtattattgtgcgagagcgggcacggggaattatctttcttactttgactactggggccagggaaccctggtcaccgtctcctca

SEQ ID NO: 2082 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatcgtgcatccaccagggccactggtatcccagccaggttcagtggcagtgggtctgggacagagttcactctcaccatcagcagcctgcaggctgaggattttgcagtttatttctgtcagcagtataataactggcctccgtacacttttggccaggggaccaagctggagatcaaa

SEQ ID NO: 2083 - DNA, 390 bp, Homo sapiens
gaggtgcagctggtggagtctgggggaggcttggtccagcctggggggtccctgagactctcctgtgcagcctctggattcacctttagtagttattggatgagctgggtccgccaggctccagggaaggggctggagtgggtggccaacataaacaaagatggaagtgagaaatactatgtggactctgtgaagggccgattcaccatctccagagacaacgccaagaactcactgtatctgcaaatgaacagcctgcgagccgaggacacggctgtgtatttctgtgcgagagattatcgatattttgactggttattatcgcaaatagacttggagattgactactttgactactggggccagggaaccctggtcaccgtctcctca

SEQ ID NO: 2084 - DNA, 321 bp, Homo sapiens
gacatccagatgacccagtctccatcctccctgtctgcatctgtaggagacagagtcaccatcacttgccgggcaagtcagagcattagcagttatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaaa

SEQ ID NO: 2085 - DNA, 363 bp, Homo sapiens
caggtgcagctggtggagtctgggggaggcgtggtccagcctgggaggtccctgagactctcctgtgcagcctctggattcaccttcagtacctatgccatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaagtggttcggggagttatttatcccactttgactactggggccagggaaccctggtcaccgtctcctca

SEQ ID NO: 2086 - DNA, 315 bp, Homo sapiens
gacatccagatgacccagtctccttccaccctgtctgcatctgtcggagacagagtcaccatcacttgccgggccagtcagactattagtaggtggttggcctggtatcagcagaaaccagggaaagcccccaagctcctgatctataaggcgtctaatttagaaagtggggtcccatcaaggttcagcggcagtggatctgggacagaattcactctcaccatcagcagcctgcagcctgatgattttgcaacttattactgccaacagtataatagttactcgttcggccaagggaccaaggtggaaatcaaa

SEQ ID NO: 2087 - DNA, 372 bp, Homo sapiens
gaggtgcagctgttggagtctgggggaggcttggtacagcctggggggtccctgagactctcctgtgcagcctctggattcacctttagtagttatgtcatgagctgggtccgccaggctccagggaaggggctggagtgggtctcagctattagtggtagtggtggcagttcatactacgcagactccgtgaagggccggttcaccatctccagagacaattccaagaacacgctgtatctgcaaatgaacagcctgagagtcgaggacacggccgtatattactgtgcgaaagacccttctggttcggggacttactactactactacatggacgtctggggcaaagggaccacggtcaccgtctcctca

SEQ ID NO: 2088 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagttctttctatgtggttttcggcggagggaccaagctgaccgtccta

SEQ ID NO: 2089 - DNA, 366 bp, Homo sapiens
gaggtgcagctggtggagtctgggggaggcttggtacagccgggggggtccctgagactctcctgtgcagcctctggattcaccttcggtacctacgacatgcactgggtccgccaaactacaggaaaaggtctggagtgggtctcagttattggtactgctggtgacacatactatccaggctccgtgaagggccgattcaccatctccagagaaaatgccaagaactccttgtatcttcaaatgaacagcctgagagccggggacacggctgtgtattactgtgcaagagctggctatgatagtagtggttattactctttctttgactactggggccagggaaccctggtcaccgtctcctca

SEQ ID NO: 2090 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaaggccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtactcttgcgctcactttcggcggagggaccaaggtggagatcaaa

SEQ ID NO: 2091 - DNA, 351 bp, Homo sapiens
gaggtgcagctggtggagtctggaggaggcttgatccagcctggggggtccctgagactctcctgtgcagcctctgaattcattgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagccgaggacacggccgtgtattactgtgcgagggactacggtgactactactttgactactggggccagggaaccctggtcaccgtctcctca

SEQ ID NO: 2092 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccaacagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatacctggccaaggacgttcggcctagggaccaaggtggaaatcaaa

SEQ ID NO: 2093 - DNA, 363 bp, Homo sapiens
caggtgcacctggtggagtctgggggaggcgtggtccagcctgggaggtccctgagactctcctgtgcagcctctggattcaccttcagtagctatgctatgcactgggtccgccaggctccaggcaagggactggagtgggtggcagttatatcatatgatggaagtaataagtactacgcagactccgtgaggggccgaatcaccatctccagagacaattccaagaacacgttgtatctgcaaatgaacagcctgagggctgaggacacggctgtgtattactgtgcgagagccttatcagccgggtatagcagcagctttgactactggggccagggaaccctggtcaccgtctcctca

SEQ ID NO: 2094 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgtcttttggccaggggaccaagctggagatcaaa

SEQ ID NO: 2095 - DNA, 363 bp, Homo sapiens
caggtgcagctggtggagtctgggggaggcgtggtccagcctgggaggtccctgagactctcctgtgcagcctctggattcatcttcagtacctatgctatgcactgggtccgccaggctccaggcaaggggctggagtgggtggcagttatatcatatgatggattcaataaatactatgcagactccgtgaagggccgattcaccatctccagagacaattccaagaacacgctgtatctgcaaatgaacagcctgagagctgaggacacggctgtgttttactgtgcgagagcacggggtgggaactacggtagcgcttttgatatctggggccaagggacaatggtcaccgtctcttca

SEQ ID NO: 2096 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggttgaggacgaggctgattattactgctgctcatatgcaggtagtaggccttgggtgttcggcggagggaccaagctgaccgtccta

SEQ ID NO: 2097 - DNA, 348 bp, Homo sapiens
caggtgcaactggtggagtctgggggaggcttggtcaagcctggagggtccctgagactctcctgtgcagcctctggattcaccttcagtgactactatatgacctggatccgccaggctccagggaaggggctggagtgggtttcatacattagtagtagtggtaatagaatatactacgcagactctgtgaagggccgattcaccatctccagggacaacgccaagaactcactgtatctgcaaatgaacagcctgagagccgaggacacggccatgtattactgtgcgacaggctgggagctactcttcaactggggccagggaaccctggtcaccgtctcttca

SEQ ID NO: 2098 - DNA, 324 bp, Homo sapiens
gaaattgtgttgacgcagtctccaggcaccctgtctttgtctccaggggaaagagccaccctctcctgcagggccagtcagagtgtaagcagcagctacttggcctggtaccagcagaaacctggccaggctcccaggctcctcatctatggtgcatcaaccagggccaccggcatcccagacaggttcagtggcagtgggtctgggacagacttcactctcaccatcagcagactggagcctgaagattttgcagtgtatttctgtcagcagtttcatgagtcacggggcactttcggccctgggaccaaagtccaaatcaaa

SEQ ID NO: 2099 - DNA, 372 bp, Homo sapiens
cagctgcagctgcaggagtcgggcccaggactggtgaagccttcggcgaccctgtccctcacctgcactgtctctggtggccccatcaacagtagaggttattcctggggctggatccgccagcccccagggaaggggctggagtgggttggggctgtctattacagtgggagtaccaactacaagccgtccctcaagagtcgagtcaccatatccgtggacacgtccaagagccagttctccctgaaggtgaactctgtgaccgccgcagatacggctgtatattactgtgtgggagaatcgggaagattacgatttttgggtaattacatggacgtctggggcaaaggggccacggtcaccgtctcatca

SEQ ID NO: 2100 - DNA, 330 bp, Homo sapiens
cagtctgtgctgactcagccaccctcagcgtctgggacccccgggcggagggtcatcatctcttgttctggaagcggctccaacatcggaagtaacactgtaaattggtaccagcagtccccaggaacggcccccaaactcctcatctatagtaataatcagcggccctcaggggtccctgaccgactctctggctccaagactggcacctcagcctccctggccatcagtgggctccagtctgaggatgaggctgattattactgtgcagcatgggatgacaccctgaatggttgggtgttcggcggagggaccaagctgaacgtccta

SEQ ID NO: 2101 - DNA, 375 bp, Homo sapiens
caggtgcagctggtgcaatctgggtctgagttgaagaagcctggggcctcagtgaaagtttcctgcaaggcttctggatacaccttcactagctatgctatgaattgggtgcgacaggcccctggacaagggcttgagtggatgggatggatcaacaccaacactgggaacccaacgtatgcccagggcttcacaggacggtttgtcttctccttggatacctctgtcagcacggcatatctgcagatcagcagcctaaaggctgaggacactgccgtgtattactgtgcgagagatggggaggccccaagtggcccctactactactactacatggacgtctggggcaaagggaccacggtcaccgtctcctca

SEQ ID NO: 2102 - DNA, 336 bp, Homo sapiens
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccgaccggttctctggagtgccagataggttcagtggcagcgggtcagggacagatttcacactgaaaatcagccgggtggaggctgaagatgttggggtttattactgcatgcaaagtctacagcttccgtacacttttggccaggggaccaagctggagatcaaa

SEQ ID NO: 2103 - DNA, 369 bp, Homo sapiens
caggtgcagctggtgcaatctgggtctgatttgaagaagcctggggcctcagtgaagatttcctgcagggcttctggatacaccttaagtaactatgctatgaattgggtgcgacaggcccctggacacgggcttgagtggatgggatggatcaacaccaatactgggaccccaacatatgcccagggcttcacgggacggtttgccttctccttggacacctctgtcaacacggcatatctgcagatcagcagcctacaggctgatgacactgccgtttattactgtgcgagagatcccggatggcagcagctggttgagaactactttgacttctggggccagggaaccctggtcaccgtctcctca

SEQ ID NO: 2104 - DNA, 321 bp, Homo sapiens
gaaatagtgatgacgcagtctccagccaccctgtctgtgtctccaggggaaagcgccaccctctcctgcagggccagtcagagtgttggcagcaacttagcctggtaccagcaggtacctggccaggctcccaggctcctcatctatggtacatccaccagggccactggtatcccagccaggttcagtggccgtgggtctgggacagagttcactctcaccatcagcagcctgcagtctgaagatattgcagtttattactgtcagcagtataataactggccgtggacgttcggccaagggaccaaggtggaaatcaga

SEQ ID NO: 2105 - DNA, 396 bp, Homo sapiens
caggtgcagctgcaggggtcgggcccaggactggtgaagccttcacagaccctgtccctcacctgcactgtctctggtggctccatcagcagtggtaattactactggagctggatccggcagcccgccgggaagggactggagtggattgggcgtatctattccagtgggagtgggaataccaagtacaacccctccctcaagagtcgagtcaccatatcagtagacacgtccaagaaccagttctccctgaagctgagctctgtgaccgccgcagacacggccgtgtattactgtgcgagcggcgagatactattaacagcagctggtacggaggactactcctactacggtatggacgtctggggccaagggaccacggtcaccgtctcctca

SEQ ID NO: 2106 - DNA, 318 bp, Homo sapiens
tcctatgagctgactcagccaccctcagtgtccgtgtccccaggacagacagccagcatcacctgctctggagataaattgggggataaatatgcttgctggtatcagcagaagccaggccagtcccctgtgctggtcatctatcaagatagcaagaggccctcagggatccctgagcgattctctggctccaactctgggaacacagccactctgaccatcagcgggacccaggctatggatgaggctgactattactgtcaggcgtgggacagcagcactgctgtcttcggaactgggaccaaggtcaccgtccta

SEQ ID NO: 2107 - DNA, 351 bp, Homo sapiens
gaggtgcagctggtggagtctgggggaggcttggtccagcggggggggtccctgagactctcctgtgcagcctctggaatcatcgtcactagcaactacatgagctgggtccgccaggctcccgggaaggggctggagtgggtctcacttatttatcccggtggtagcacatactatgtagactccgtgaagggcagattcaccatctccagagacaattccaagaacacgctgtatcttcaaatgaacagcctgagagtcgaggacacggctgtgtattactgtgcgagagattttcaggaaggtgcttttgatatctggggccaagggacaatggtcaccgtctcttca

SEQ ID NO: 2108 - DNA, 324 bp, Homo sapiens
gacatccagttgacccagtctccatccttcctgtctccatctgtaggagacagagtcaccatcacttgccgggccagtcagggcattgcaagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccctccgatcactttcggccctgggaccaaagtagatatcaaa

SEQ ID NO: 2109 - DNA, 366 bp, Homo sapiens
caggtccagctggtgcagtctggggctgaggtgaagaagcctgggtcctcgctgagggtctcctgcaaggcttctggaggcaccttcagcagctacgttatcagctgggtgcgacaggcccctggacaggggcttgagtggatgggaaggatcatccctatccttggtataccaaactacgcacagacgttccaggacagagtcacgattaccgcggacaaatccacgggcacagcctacatggacctgagcagcctgagatgtgaggacacggccgtgtattattgtgcgagagaggggggatattgtagaagtaccagctgcttcgactactggggccagggaatcctggtcaccgtctcctca

SEQ ID NO: 2110 - DNA, 333 bp, Homo sapiens
cagtctgtgctgacgcagccgccctcagtgtctggggccccagggcagagggtcaccatctcctgcactgggaggaactccaacatcggggcaggttatgatgtacactggtaccagcagcttccaggaacagcccccaaagtcctaatctataataacaggaatcggccctcaggggtccctgaccgattctctggctccaagtctggcacctcagcctccctggccatcactgggctccaggctgaggatgaggctgattattattgccagtcctatgacagcagcctgagtgacgtggttttcggcggagggaccaagctgaccgtccta

SEQ ID NO: 2111 - DNA, 357 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggattggcttgcacgcattgattgggatgatgataaatactacagcacatctctgcagaccaggctcaccatctccaaggacacctccaaaaaccaggtggtccttacaatgaccaacatggaccctgtggacacagccacctattactgtgcacgggaaactccggtgactactattgactactggggccagggaaccctggtcaccgtctcctca

SEQ ID NO: 2112 - DNA, 321 bp, Homo sapiens
gacatccagatgacccagtctccatcctccctgtctgcgtctgtaggagacagagtcaccatcacttgccgggcaagtcagagcattcgcacctatttaaattggtatcagcagaaaccagggaaagcccctaacctcctgatctatgctgcatccagtttgcaaagaggggtcccatcaaggttcagtggcagtggatctgggacagatttcactctcaccatcagcagtctgcaacctgaagattttgcaacttactactgtcaacagagttacagtacccctcgaacgttcggccaagggaccaaggtggaaatcaaa

SEQ ID NO: 2113 - DNA, 366 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaggggcttgagtggatgggaggttttgatcctgaaaatactgaaacaatctacgcacagaagttccagggcagagtcaccatgaccgaggacacatctacagacacagcctacatggagctgagcagcctgagatctgaggacacggccgtgtattactgtgcaacaggccccgcgagcttcggggagttattttcttcttactactggggccagggaaccctggtcaccgtctcctca

SEQ ID NO: 2114 - DNA, 330 bp, Homo sapiens
cagtctgtgctgactcagccaccctcagcgtctgggacccccgggcagagggtcaccatctcctgttctggaagcagctccaacatcggaagaaattatttatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtggggtgttcggcggagggaccaagctgaccgtccta

SEQ ID NO: 2115 - DNA, 381 bp, Homo sapiens
gaagtgcagctggtggagtctgggggaggcgtggtacagcctggggggtccctgagactctcctgtgcagctactggattcacctttgatgcttatgccatgcactgggtccgtcaagctccagggaagggtctggagtgggtctctcttattagtggggatggtagtagcacatactttgcagactctgtgaagggccgattcaccatctccagagacaacagcaaaaactcactgtatctgcaaatgaacagtctgacaactgaggacaccgccttgtatcactgtggaaaagatagagggggcagtggctgggacctcaactactactactacggtctggacgtctggggccaagggaccacggtcaccgtctcctca

SEQ ID NO: 2116 - DNA, 321 bp, Homo sapiens
gacatccagttgacccagtctccatccttcctgtctgcatctgtaggagacagagtcaccatcacttgccgggccagtcagggcattaggagttatttagcctggtatcagcaaaaaccagggaaagcccctaagctcctgatctatgctgcatacagtttgcaaagtggggtcccatcaaggttcagcggcagtggatctgggacagaattcactctcacaatcagcagcctgcagcctgaagattttgcaacttattactgtcaacaggttaatagttaccctctcactttcggcggagggaccaaggtggaggtcaaa

SEQ ID NO: 2117 - DNA, 369 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagccccccctatgggccactcacttacacactggttcgacccctggggccagggaaccctggtcaccgtctcctca

SEQ ID NO: 2118 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctttaataataatcagcggccctcaggggtccctgaccgattctctggctccaagtctggcacctcagcctccctggccatcagtgggctccagtctgaggatgaggctgattattactgtgcagcgtgggatgacagcctgaatggttgggtgttcggcggagggaccaagctgaccgtccta

SEQ ID NO: 2119 - DNA, 369 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaaaatgttgaaacaatctacgcacagaagttccagggcagagtcaccatgaccgaggacacatctacagacacagcctacatggaactgagcagcctcagatctgaggacacggccgtgtattactgtgcaactggccccgctttgagaacgctagaacagacctggttcgacccctggggccagggaaccctggtcaccgtctcctca

SEQ ID NO: 2120 - DNA, 330 bp, Homo sapiens
cagtctgtgttgacgcagccgccctcactgtctgcggccccaggacagaaggtcaccatctcctgctctggaagcagctccaacattggaaataattatgtatgctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgcgtggaggggtgttcggcggagggaccaagctgaccgtccta

SEQ ID NO: 2121 - DNA, 384 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatttataccagtgggagcaccaactacaacccctccctcaagagtcgagtcaccatgtcagtagacacgtccaagaaccacttctccctgaagctgaggtctgtgaccgccgcagacacggccgtgtattactgtgcgagaggtatagcagtggctggggacgacgattactactattactacggtttggacgtctggggccaagggaccacggtcaccgtctcctca

SEQ ID NO: 2122 - DNA, 324 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtgatggtgataaataaagacagtgagaggccctcagggatccctgagcgattctctggctccagctcagggacaacagtcacgttgaccatcagtggagtccaggcagaagacgaggctgactattactgtcactcagcagacagcagtggtacttattgggtgttcggcggagggaccaagctgaccgtccta

SEQ ID NO: 2123 - DNA, 360 bp, Homo sapiens
caggtgcagctggtgcagtctggggctgaggtgaagaagcctggggcctcagtgaaggtttcctgcaaggcatctggatacaccttcaccaactactatatgcactgggtgcgacaggcccctggacaagggcttgagtggatgggaataatcaaccctagtgatgataacacaacctacgcacagaagatccagggcagagtcatcatgaccagggacacgtccacgagcacagtctacatggagctgagcagcctgagatctgaggacacggccgtgtattactgtgcgagagcattcgcggagtgggagctactacttgactactggggccagggaaccctggtcaccgtctcctca

SEQ ID NO: 2124 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaaggtcaccgtccta

SEQ ID NO: 2125 - DNA, 378 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtgatggcacaacctatgcacagaagtttcagggcagggtcaccatgaccagggacacgtccatcagcacagcctacatggagctgagcagcctgaaatctgacgacacggccgtatattattgtgcgagaggctacggtgactacgaggactattacttctactactacggtatggacgtctggggccaagggaccacggtcaccgtctcctca

SEQ ID NO: 2126 - DNA, 321 bp, Homo sapiens
gacatccagatgacccagtctcctttcaccctgtctgcatctgtaggagacagagtcaccatcacttgccgggccagtcagagtattagtagccggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaactttttactgccaacagtataatagttatccgtggacgttcggccaagggaccaaggtggaaatcaaa

SEQ ID NO: 2127 - DNA, 366 bp, Homo sapiens
cagctgcagctgcaggagtcgggcccaggactggtgaagccttcggagaccctgtccctcacctgcactgtctctggtggctccctcagcagtagtagttactactggggctggatccgccagcccccagggagggggctggagtggattgggagtatcaattatagtgggagcacctactacaacccgtccctcaagagtcgagtcaccatatccgtagacacgtccaagaaccagttctccctgaagctgagctctgtgaccgccgcagacacggcggtgtattactgtgtcggggttcggggacttcttattctgttctggttcgacccctggggccagggaaccctggtcaccgtctcctca

SEQ ID NO: 2128 - DNA, 333 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccgctttgatctatgaggataaccaaagaccctctggggtccctgatcggttctctggctccatcgacagctcctccaactctgcctccctcaccatctctggactgaagactgaggacgaggctgactactactgtcagtcttatgatagcagcaccctttgggtgttcggcggagggaccaagctgaccgtccta

SEQ ID NO: 2129 - DNA, 384 bp, Homo sapiens
gaggtgcagctggtggagtctgggggaggcttggtacagcctggggggtccctgagactctcctgtgcagcctctggattcaccttcagtagctacgacatgcactgggtccgccaagctgcaggaaaaggtctggagtgggtctcagtaattgggactgctggtgacacatactatccaggctccgtgaagggccgattcaccatctccagagagaatgccaagaactccttgtatcttcaaatgaccagcctgagagccggggacacggctgtgtattactgtgcaagaggagtggatacagctatggttagggggggtaaactctactacttctactatatggacgtctggggccaagggaccacggtcaccgtctcctca

SEQ ID NO: 2130 - DNA, 324 bp, Homo sapiens
gacatccagatgacccagtctccatcctccctgtctgcatctgtaggagacagagtcaccatcacttgccgggcaagtcagagcattagcagttatttaaattggtatcagcagaaaccagggaaagcccctaagctcctgatctatgctgcatccattttgcaaggtggggtcccatcaaggttcagtggcagtggatctgggacagatttcactctcaccatcagcagtctacaacctgaagattttgcaacttactactgtcaacagagttacgttacccctccggtcactttcggccctgggaccaaagtggatatcaaa

SEQ ID NO: 2131 - DNA, 342 bp, Homo sapiens
gaggtgcaactggtggagtccgggggaggcttagttcagcctggggggtccctgagactctcctgtgcaggctctggattcaccctcagtggcaactggatgtactgggtccgccaagttccagggaagggcctggtgtgcgtcgcacgtattaatgttgatgggagtgacacaacgtacgcggactccgtgaagggtcgattcaccatctccagagacgacgccaagaacacgatgtatctgcaaatgaatagtctgagagccgaggacacggctgtctattactgtgtaatagtgagactggggtcctggggccagggaaccctggtcaccgtctcctcg

SEQ ID NO: 2132 - DNA, 327 bp, Homo sapiens
caggctgtggtgactcaggagccctcactgactgtgtccccaggagggacagtcactctcacctgtggcctcagaactggagctgtcaccattggtcataatccctactggttccagcagaagcctggccaagcccccaggacactgatttgggatgcaacccacaaattttcttggacacctgcccgcttctcaggctccctccttggggacaaagctgccctgaccctttcgggtgcgcagcctgaagatgaggctgactactattgcttcttctcctattacggtagtgcggtcttcggcggagggaccagactgaccgtccta

SEQ ID NO: 2133 - DNA, 372 bp, Homo sapiens
caggtgcagctgcaggagtcgggcccaggactggtgaagccttcggagaccctgtccctcacctgcactgtctctggtggctccatcagtacttactactggagctggatccggcagcccccagggaagggactggagtggattgggtatatcacttacagtgggagtaccaactacaacccctccctcaagagtcgagtcaccatatcagtagacacgtccaagaaccagttctccctgaagctgaggtctgtgaccgctgcggacacggccgtgtattattgtgcgagaggggtggtgattgctattccaagctactactactacggtatggacgtctggggccaagggaccacggtcaccgtctcctca

SEQ ID NO: 2134 - DNA, 327 bp, Homo sapiens
tcctatgtgctgactcagccgccctcagtgtcactggccccaggaaagacggccaggattacctgtgggggaaacaacattggaagtaaaagtgtacactggtaccagcagaagccaggccaggcccctgtgctggtcatctattatgatagcgaccggccctcagggatccctgagcgattctctggctccaactctgggaacacggccaccctgaccatcagcagggtcgaagccggggatgaggccgactattactgtcaggtgtgggatagtaatagtgatcatgccgtggtgttcggcggagggaccaagctgaccgtccta

SEQ ID NO: 2135 - DNA, 366 bp, Homo sapiens
caggtccaactggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaagatggtgaaacagtctacgcacagaagttccagggcagagtcaccatgaccgaggacacatctacagacacagcctacatggagctgagcagcctgagatctgaggacacggccgtgtattactgtgcaaccgagagtccttttccagcggctgttggctggttcgacccctggggccagggaaccctggtcaccgtctcctcg

SEQ ID NO: 2136 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatcatgtcactaagcggccctcaggggttgctaatcgcttctctggctccaagtctggcaacacggcctccctgaccatctctgggctccaggctgaggacggggctgattattactgcagctcatatacaagcaccagcactcgggtgttcggcggagggaccaagttgaccgtccta

SEQ ID NO: 2137 - DNA, 363 bp, Homo sapiens; identical to SEQ ID NO: 1853

SEQ ID NO: 2138 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcctatcactttcggcggagggaccaaggtggagatcaaa

SEQ ID NO: 2139 - DNA, 357 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacaccacatctctgattaccaggctcaccatctccaaggacacctccaaaaaccaggtggtccttacaatgaccaacatggaccctgtggacacagccacgtattactgttcacgggaagctcggggagttatccttgactactggggccagggaaccctggtcaccgtctcctca

SEQ ID NO: 2140 - DNA, 321 bp, Homo sapiens
gacatccagatgacccagtctccatcctccctgtctgcatctgtaggagacagagtcaccatcgcttgccgggcaagtcagaacattcgcagctatttaaattggtatcagcagagtccagggaaagcccctaagctcctgatctttgctgcatccagtttgcaaagtggggtcccatcaaggttcagtggcagtggatctgggacagatttcactctcaccatcagcagtctgcaacctgaagattttgcaacttactactgtcaacagagtttcagtacccctcggacgttcggccaagggaccaaggtggaaatcaaa

SEQ ID NO: 2141 - DNA, 384 bp, Homo sapiens
caggtccagctggtacagtctggggctgaggtgaagaagcctggggcctcagtgaaggtctcctgcagggtttccggatacaccctcactgaattatccatgcactgggtgcgacaggctcctgggaaagggcttgagtggatgggaggttttgatcctgaaaagggagagacaatctacgcacagaagttccagggcagagtcaccatgaccgaggacacatctacagacacagcctacatggagctgagcagcctgagatctgaggacacggccgtgtattactgtgcaacagccacggcgattcagggagttcccactgactactactatcactacggtatggacgtctggggccaagggaccacggtcaccgtctcctca

SEQ ID NO: 2142 - DNA, 330 bp, Homo sapiens
cagtctgccctgactcagcctgcctccgtgtctgggtctcctggacagtcgatcaccctctcctgcactggaaccagcagtgacgttggtggttataactatgtctcctggtgccaacagtgcccaggcaaggcccccaaactcatgatttatgatgtcagtaagcggccctcaggggtttctcatcgcttctctggctccaagtctggcaacacggcctccctgaccatctctgggctccaggctgaggacgaggctgattattactgcttctcatatacaagcagcagcacttatgtcttcggaactgggaccaaggtcaccgtccta

SEQ ID NO: 2143 - DNA, 387 bp, Homo sapiens
gaagtgcagctggtggagtctgggggaggcttggtacagcctggcaggtccctgagactctcctgtgcagcctctggattcacctttgatgattatgccatgcactgggtccggcaagctccaggggagggcctggagtgggtctcaggtattagttggaatagtggtagcataggctatgcggactctgtgaagggccgattcaccatctccagagacaacgccaagaactccctgtatctgcaaatgaacagtctgagagctgaggacacggccttgtattactgtgcaaaagatacgcggttctcattcggaacgatagcagcagctgtaagtgggtacggtatggacgtctggggccaagggaccacggtcaccgtctcctca

SEQ ID NO: 2144 - DNA, 324 bp, Homo sapiens
cagtctgccctgactcagcctgcctccgtgtctgggtctcctggacagtcgatcaccatctcctgcactggaaccagcagtgatgttggtatttttaaccttgtctcctggtaccaacagcacccaggcaaagcccccaaactcatgatttatgaggtcactaagcggccctcaggggtttctaatcgcttctctggctccaagtctggcaacacggcctccctgacaatctctgggctccaggctgaggacgaggctgattattactgctgctcatatgcaggtagttatgtcttcggaactgggaccaaggtcaccgtccta

SEQ ID NO: 2145 - DNA, 369 bp, Homo sapiens
gaggtgcagctggtgcagtctggagcagaggtgaagaagcccggggagtctctgaagatctcctgtaaggcttctggatacagctttaccatctactggatcggctgggtgcgccagatgcccgggaaaggcctggagtggatgggggtcatctatcctggtgactctgataccagatacagcccgtccttccaaggccaggtcaccatctcagccgacaagtccatcagcaccgcctacctgcagtggagcagcctgaaggcctcggacaccgccatgtattactgtgctttagggtatcattcagggagttatccctttaactggttcgacccctggggccagggaaccctggtcaccgtctcctca

SEQ ID NO: 2146 - DNA, 318 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccagactcccaggctcctcatctatggtgcatccaccagggccactggtatcccagccaggttcagtggcagtgggtctgggacagagttcactctcaccatcagcagcctgcagtctgaagattttgcagtttattactgtcagcagtatgataaccttctcactttcggcggagggaccaaggtagagatcaaa

SEQ ID NO: 2147 - DNA, 372 bp, Homo sapiens
caggtccagctggtacagtctggggctgaggtgaagaagcctggggcctcagtgaaggtctcctgcaaggtctccggatacatgctcattgaattatccatgcactgggtgcgacaggctcctggaaaagggcttgagtggatgggaggttttgatcctgaagatgctgaaacaatgtacgcacagaatttccagggcagagtcaccatgaccgaggacacatctacagacacagcctacatggagctgagcagcctgacatctgaggacacggccgtatattactgtgcaacagcatatgcatattgtgctggtgactgctatagatttgtggactactggggccagggaaccctggtcaccgtctcctca

SEQ ID NO: 2148 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgttagtaagcggccctcaggggtttctaatcgcttctctggctccaagactggcaacacggcctccctgaccatctctgggctccaggctgatgacgaggctgattattactgcagctcattcacaagcggcagcactctcgtgttcggcggagggaccaagctgaccgtccta

SEQ ID NO: 2149 - DNA, 363 bp, Homo sapiens
caggtccaggtggtacagtctggggctgaggtgaagaagcctggggcctcagtgaaggtctcctgcaaggtttccggatacaccctcactgagttatccatgcactgggtgcgacaggctcctggaaaagggcttgagtggatgggaggttttgatcctgaagatgctgaaacaatctacgcacagaagttccagggcagagtcaccatgaccgaggacacatctacagacacagcctacatggagctgagcagcctgagatctgaggacacggccgtgtattactgtgcaacatccccctcagtggtggtagctgctactccatattactggggccagggaaccctggtcaccgtctcctca

SEQ ID NO: 2150 - DNA, 330 bp, Homo sapiens
cagtctgtgctgactcagccaccctcagcgtctgggacccccgggcagagggtcaccatctcttgttctggaagcagctccaacatcggaagtaaatatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtccggtgttcggcggagggaccaagctgaccgtccta

SEQ ID NO: 2151 - DNA, 357 bp, Homo sapiens
gaggtgcagctggtggagtctgggggaggcttggtccagcctggggggtccctgagactctcctgtgcagcctctggattcacctttaataattattggatgacctgggtccgccaggctccagggaaggggctggagtgggtggccaacataaagcaagatggaagtgagaaatactatgtggactctgtgaagggccgattcaccatctccagagacaacgccaagaagtcactgtgtctgcaaatgaacagcctgagagccgaggacacggctgtgtattactgtgcgagagctttctggttcggggggtacttcgatctctggggccgtggcaccctggtcactgtctcctca

SEQ ID NO: 2152 - DNA, 330 bp, Homo sapiens
aattttatgctgactcagccccactctgtgtcggaatctccggggaagacggtgaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcatttgggtgttcggcggagggaccaagttgaccgtccta

SEQ ID NO: 2153 - DNA, 354 bp, Homo sapiens
cagatcaccttgaaggagtctggtcctacgctggtgaaacccacacagaccctcacgctgacctgcaccttctctgggttctcactcagcactattggagtgggtgtgggctggatccgtcagccccctggaaaggccctggagtggcttgcagtcatttattgggatgatgataagcgctacagcccatctctgaagagcaggctcaccatcaccaaggacacctccaaaaaccaggtggtccttacaatgaccaacatggaccctgtggacacagccacatatttctgtacacacgtagcaacagctgactctgactactggggccagggaaccctggtcaccgtctcctca

SEQ ID NO: 2154 - DNA, 321 bp, Homo sapiens
gaaatagtgatgacgcagtctccagccaccctgtctgtgtctccaggggaaagagccaccctctcctgcagggccagtcagactgttagcagcaacttagcctggtaccagcagaaacctggccaggctcccaggctcctcatctatgctgcatccaccagggccactggtatcccagccaggttcagtggcagtgggtctgggacagagttcactctcaccatcagcagcctgcattctgaagattttgcactctattactgtcaacattatgataactggccgtggacgttcggccaagggaccaaggtggacatcaaa

SEQ ID NO: 2155 - DNA, 345 bp, Homo sapiens
caggtgcagctggtgcagtctggggctgaggtgaagaagcctggggcctcagtgaaggtctcctgcaaggcttctggatacaccttcagcatttatgatatcaactgggtgcgacaggccactggacaaggacttgagtggctgggatggatgagccctaacagtggttacacaggctatgcacagaagttccagggcagagtcaccatgaccaggaacacctccataaccacagcctacatggagctgagcagcctgagatctgaagacacggccgtctattactgtgctatagggacgcctagtaaccgctggggccagggaaccctggtcaccgtctcctca

SEQ ID NO: 2156 - DNA, 321 bp, Homo sapiens
gacatccagatgacccagtctccttccaccctgtcttcatctgtaggagacagagtcaccatcacttgccgggccagtcagagtattagtagctggttggcctggtatcagcagaaaccagggaaagcccctaaactcctgatctataaggcgtctagtttagacagtgcggtcccatcaaggttcagcggcagtggatctgggacagaattcactctcaccatcagcagcctgcagcctgatgattttgcaacttattactgccaacagtataatagttattctcgtacgttcggccaagggaccaaggtggaaatcaaa

SEQ ID NO: 2157 - DNA, 372 bp, Homo sapiens
caggtgcaactgcaggagtcgggcccaggactggtgaagccttcggggaccctgtccctcacctgcgctgtctctggtggctccatcagcagtagtgtctactggagttgggtccgccagcccccagggaaggggctggagtggattggggaaatctatcatagtgggagcagcaactacaacccgtccctcaagagtcgagtcaccatttcagttgacaagtccaagaaccagttctccctgaaactgagctctgtgaccgccgcggacacggccgtgtattactgtgcgagaatcggccccccctctggttcagggagcacacgcacatttgactactggggccagggaaccctggtcaccgtctcctca

SEQ ID NO: 2158 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagctcccaggcaaagcccccaaactcatgatttatgaggtcattaagcggccttcaggggtttctaatcgcttctctggctccaagtccggcaacacggcctccctgacaatctctgggctccaggctgaggacgaggctgattattactgctgctcatatgcaggtagtagcacttgggtgttcggcggagggaccaagctgaccgtccta

SEQ ID NO: 2159 - DNA, 357 bp, Homo sapiens
caggttcagctggtgcagtctggagttgaggtgaagaagcctggggcctcagtgaaggtctcctgcaaggcctctggttacacctttaccagctatggtatcagctgggtgcgacaggcccctggacaaggtcttgagtggatgggatggatcagcgcttacaatggtaacacaaactatgcacagaagttccagggcagagtcaccatgaccacagacacatccacgagcacagcctacatggaactgaggagcctgagatctgacgacacggccgtgtattactgtgcgagagacttcggggaattattaccttttgactactggggccagggaaccctggtcaccgtctcctca

SEQ ID NO: 2160 - DNA, 318 bp, Homo sapiens
gaaattgtgttgacacagtctccagccaccctgtctttgtctccaggggaaagagccaccctctcctgcagggccagtcagagtgttaacatctacttagcctggtaccaacagaaacctggccaggctcccaggctcctcatctatgatgcatccgacagggccactggcatcccacccaggttcagtggcagtgggtctgggacagacttcactctcaccatcagcagcctagagcctgaagattttgcagtttattactgtcaacagcgtatcaacggtctcactttcggcggagggaccaaggtggagatcaaa

SEQ ID NO: 2161 - DNA, 360 bp, Homo sapiens
cagctgcagctgcaggagtcgggcccaggactggtgaagccttcacagaccctgtccctcacctgcactgtctctggtggctccatcagcagtggtagttactactggagctggatccggcagcccgccgggaagggactggagtggattgggagtatctataccagtgggagcacctactacaacccgtccctcaagagtcgagtcaccatatccgtagacacgtccaagaaccagttctccctgaagctgagctctgtgaccgccgcagatacggctgtgtattactgtgcgagaaagaactggctacagggaagttttgattactggggccagggaaccctggtcatcgtctcctca

SEQ ID NO: 2162 - DNA, 333 bp, Homo sapiens
aattttatgctgactcagccgcactctgtgtcggagtctccggggaagacggtaaccatctcctgcacccgcagcagtggcagcattgccaacaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgataccagcaatcatggggtgttcggcggagggaccaagctgaccgtccta

SEQ ID NO: 2163 - DNA, 369 bp, Homo sapiens
caggtccagctggtacagtctggggctgaggtgaagaagcctggggcctcagtgaaggtctcctgcaaggtttccggatacaccctccctgaattatccatgcactgggtgcgacaggctcctggaaaagggcttgagtggatgggaggttttgatcctgaagatggtgaaacaatctacgcacaagagttccagggcagagtcaccatgaccgaggacacatctacagacacagcctacatggagctgagcagcctgagatctgaggacacggccgtctattactgtgcaataacaacccccttcggtgaccatggcccagggtggttccacccctggggccagggaaccctggtcaccgtctcctca

SEQ ID NO: 2164 - DNA, 324 bp, Homo sapiens
gaaattgtgttgacgcagtctccaggcaccctgtgtttgtctccaggggaaagagccaccctctcctgcagggccagtcagagtgttagcagcagctacttagcctggtaccagcagaaacctggccaggctcccaggctcctcatctatggtgcatccagcagggcccctggcatcccagacaggttcagtggcagtgggtctgggacagacttcactctcaccatcagcagactggagcctgaagattttgcagtgtatcactgtcagcagtatggtaggccacctctcactttcggcggagggaccaaggtggagatcaaa

SEQ ID NO: 2165 - DNA, 369 bp, Homo sapiens
caggtccagctggtacagtctggggctgaggtgaagaagcctggggcctcagtgaaagtctcctgcaaggtttccggatacaccctcgttgaattatccattcactgggtgcgacaggtacctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacttccccccctatgggccgcccacttacacactggttcgacccctggggccagggaaccctggtcaccgtctcctca

SEQ ID NO: 2166 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccaccaggtcccaggaacggcccccaaactcctcatctataataatcatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtccta

SEQ ID NO: 2167 - DNA, 363 bp, Homo sapiens
gaggtgcaggtggtggagtctgggggaggcttggtccagccgggggggtcccggagactctcctgtacagcctctggattcacgttgagaaattattggatgagctgggtccgccaggctccagggaaggggcttgagtgggtggccaacataaagcaagatggaagtgagaaatactatgtggactctgtgaagggccgattcaccatctccagagacaacgccaagaattccctgtatctacaaatggacagcctgagagccgaggacacggctgtctattactgtgcgagaggagggagatattgtcctggtggtagttgccctaggtggggccggggaaccctggtcaccgtctcctca

SEQ ID NO: 2168 - DNA, 324 bp, Homo sapiens
gacatccagatgacccagtctccatcctccctgtctgcatctgtaggagacagagtcaccatcacttgccaggcgagtcaggacattagtaattttttaaattggtatcagctgaaaccaggagaagcccctacactcctgatcttcgatgcgtccaaattggaaacaggggtcccatcaaggttcagtggaactggatttgggacagattttactttcaccatcagcagcctgcagcctgaagacactgcaacatattactgtcaacaatatgatgatctcacttcaatcaccctcggccaagggacacgactggagatcaaa

SEQ ID NO: 2169 - DNA, 384 bp, Homo sapiens
gaggtgcagctggtggagtctgggggaggcctggtcaagcctggggggtccctgagactctcctgtgcagcctctggattcaccttcagaagctatagcatgaactgggtccgccaggctccagggaaggggctggagtgggtctcatccattagtagtactaatagtaatatatactacgcagactcagtgaagggccgattcaccatctccagagacaacgccaagaactcactgtatctgcagatgaacagcctgagagccgaggacacggctgtttattactgtgcgagagatcgctatggtggctggccccctatagtttactactactactatggtatggacgtctggggccaagggaccacggtcaccgtctcctca

SEQ ID NO: 2170 - DNA, 330 bp, Homo sapiens
cagtctgtgttgacgcagccgccctcagtgtctgcggccccaggacagagggtcaccatctcctgctctggaagcaactccaacattgggactaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggaacattcggcggagggaccaagctgaccgtcctg

SEQ ID NO: 2171 - DNA, 381 bp, Homo sapiens
caggtgcagctgcaggagtcgggcccaggactggtgaagccttcggggaccctgtccctcacctgcgaagtctctggtggctccatcagcagtagtaactggtggagctgggtccgccagcccccaggaaaggggctggagtggattggggacatctatcatagtgggagcactaactacaacccgtccctcaagagtcgagtcaccatagcagtagataagtccaagaaccagttctccctgaacctgaactctgtgaccgccgcggacacggccgtgtattattgtgcgagagaaggggtagcagtgactggcccacacatgttcggctattacggtatcgacgtctggggccaagggaccacggtcaccgtctccgca

SEQ ID NO: 2172 - DNA, 324 bp, Homo sapiens
tcttctgagctgactcaggaccctgctgtgtctgtggccttgggacagacagtcaggatcacatgccaaggagacagcctcagaacctattatgcaacctggtaccagcagaagccaggacaggcccctgtacttgtcatctatgataaaaacaaccggccctcagggatcccagaccgattctctggctccagctcaggaaacacagcttccttgaccatcactggggctcaggcggaagatgaggctgactattactgtaactcccgggacagcagtggtaaccatctggtgttcggcggagggaccaagctgaccgtccta

SEQ ID NO: 2173 - DNA, 354 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacatattaatagtgatgggagtagcacgagctacgcggactccgtgaagggccgattcaccatctccagagacaacgccaagaacacgctgtatctgcaaatgaacagtctgagagccgaggacacggctgtgtattactgtgcaagaggcttacgatattttgacctggacgtctggggccaagggaccacggtcaccgtctcctca

SEQ ID NO: 2174 - DNA, 330 bp, Homo sapiens
cagtctgtgctgactcagccaccctcggtgtctgaagcccccaggcagagggtcaccatctcctgttctggaagcagctccaacatcggaaataatgctgtgaactggtaccagcagctcccaggaaaggctcccaaactcctcatcttttatgatgatctgctgccctcaggggtctctgaccgattctctggctccaagtctggcacctcagcctccctggccatcagtgggctccagtctgaggatgaggctgattattactgtgcagcatgggatgacagcctgaatggtggggtgttcggcggagggaccaaactgaccgtccta

SEQ ID NO: 2175 - DNA, 363 bp, Homo sapiens
caggtgcagctggtggagtctgggggaggcgtggtccagcctgggaggtccctgagactctcctgtgcagcctctggattcaccttcagtacctatgctctgcactgggtccgccagggtcctggcaagggactggagtgggtggcagttatatcatatgatggatacaataaatactacgcagactccgtgaagggccgattcaccatctccagagacaattccaagaacacgctgtatctgcaaatgaacagcctgagaactgaggacacggctgtgtattactgtgcgagaagtgccgggggtggctactacaatcattacgacccctgcggccagggaaccctggtcaccgtctcctcc

SEQ ID NO: 2176 - DNA, 321 bp, Homo sapiens
gaaattgtgctgactcagtctccagactttcagtctgtgactccaaaggagaaagtcaccatcacctgccgggccagtcagagcattggtagtagcttacactggtaccagcagaaaccagatcagtctccaaagctcctcatcaagtatgcttcccagtccttctcaggggtcccctcgaggttcagtggcagtggatctgggacagatttcaccctcaccatcaatagcctggaagctgaagatgctgcaacgtattactgtcatcagagtagtagtttacctcacacttttggccaggggaccaagctggagatcaaa

SEQ ID NO: 2177 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatctcatatgatggacgtaataaatactacgcagactccgtgaagggccgattcaccatctccagagacacttccaagaacacgctgtatctgcaaatgaacagcctgagaactgacgacacggctgtatattactgtgcgagagtcgggggtgtgggattctggctacgagcctggcttgactactggggccagggaaccctggtcaccgtctcctca

SEQ ID NO: 2178 - DNA, 330 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctccggactgaagactgaggacgaggctgactactattgtcagtcctacgatagcagcaattgggtgttcggcggagggaccaagctgaccgtccta

SEQ ID NO: 2179 - DNA, 366 bp, Homo sapiens
gaggtgcagctggtggagtccgggggaggcttagttcagcctggggggtccctgagactctcctgtgcagcctctggattcaccttcagtagttattggatgcactgggtccgccaaggtccagggaaggggctgctgtgggtctcacgtattaatagtgatgggagtagcacattctacgcggactccgtgaagggccgattcaccatctccagagacaacgccaagaacacactgtatctgcaaatgaacagtctgagagccgaagacacggctgtgtattactgtgcaagagtccgaggaggcaacggtgactacggctggttcgacccctggggccagggaaccctggtcaccgtctcctca

SEQ ID NO: 2180 - DNA, 315 bp, Homo sapiens
tcctatgtgctgactcagccaccctcagtgtcagtggccccaggaaagacggccaggattacctgtgggggagacaacattggaagtaaaagtgtgcactggtaccagcagaagccaggccaggcccctgtgctggtcatctattatgatagcgaccggccctcagggatccctgagcgattctctggctccaactctggcaacacggccaccctgaccatcagcagggtcgaagccggggatgaggccgactattactgtcaggtgtgggatagtactgtggtattcggcggagggaccaagctgaccgtccta

SEQ ID NO: 2181 - DNA, 369 bp, Homo sapiens
gaagtgcagctggtggagtctgggggaggcgtggtacagcctggggggtccctgagactctcctgtgcagcctctggattcacctttcatgattatgccatgcactgggtccgtcaagctccagggaagagtctggagtgggtctctcttattattggggatggtggtggcacattctatgcagactctgtgaagggccggttcaccatctccagagacaacagcaaaaattccctgtatctgcaaatgaacagtctgagaactgaggacaccgccttgtatttctgtgcaaaagattctagtacggttcagggatgggtatcctggttcgacccctggggccagggaaccctggtcaccgtctcctca

SEQ ID NO: 2182 - DNA, 324 bp, Homo sapiens
gacatccagatgacccagtctccatcctccctgtctacatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctccgtggacttttggccaggggaccaagctggagatcaaa

SEQ ID NO: 2183 - DNA, 360 bp, Homo sapiens
caggtgcagctgcaggagtcgggcccaggactggtgaagacttcggggaccctgtccctcacctgcgctgtctctggtggctccatcagcagtagtaactggtggagttgggtccgccagcccccaggggaggggctggagtggattggggaaatctatcatagtgggagcaccaactacaatccgtccctcaagagtcgagtcaccatatcagtagacaagtccaagaaccagttctccctgaacctgagctctgtgaccgccgcggacacggccgtgtattactgtgcgagaccgcttattggtgttagcagtggcggggactactggggccagggaaccctggtcaccgtctcctca

SEQ ID NO: 2184 - DNA, 330 bp, Homo sapiens
cagtctgttctgactcagccaccctcagcgtctgggacccccgggcagagggtcaccatctcttgttctggaagcagctccaacatcggaagttatgctgtaacctggtaccagcagctcccaggaacggcccccaaactcctcatctatagtactaatcagcggccctcaggggtccctgaccgattctctggctccaagtctggcacctcagcctccctggccatcagtgggctccagtctgaggatgaggctgattattactgtgcagcatgggatgacagcctgaatggtccggtgttcggcggagggaccaagctgaccgtccta

SEQ ID NO: 2185 - DNA, 375 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaagtaaaaaatactacgcagactccgtgaagggccgattcaccatctccagagaccattccaggaacacgctgtatctgcaaatgaacagcctgagagctgaggacacggctgtgtattactgtgcgagagagtctagcgggtataccagtggctggttcacagggacaatggacgtctggggccaagggaccacggtcaccgtctcctca

SEQ ID NO: 2186 - DNA, 321 bp, Homo sapiens
gacatccagatgacccagtctccatcctccctgtctgcatctgtaggagacagagtcaccatcacttgccgggcaagtcagagcattagcaactctttaaattggtatcagcagaaaccagggaaagcccctgagctcctgatctatgcagcatccagtttgcaaagtggggtcccatcaaggttcagtggcagtggatctgggacagatttcactctcaccatcagcagtctgcaacctgaagattttgctacttactactgtcaacagagttacactagccggctcactttcggcggagggaccaaggtggagatcaaa

SEQ ID NO: 2187 - DNA, 366 bp, Homo sapiens
caggtgcagctggtggagtctgggggaggcgtggtccagcctgggaggtccctgagactctcctgtgcagcctctggattcaccttcagtaactatcctatgcactgggtccgccaggctccaggcaaggggctggagtgggtggcagttatatcatatgatggaagcaataaatactacgcagactccgtgaagggccgattcaccatctccagagacaattccaagaacacgctgtatctgcacatgaacagcctgagaggtgaggacacggctctgtattactgtgcgagagacggggttacagggagcgactcatacggtatggacctctggggccaagggaccacggtcaccgtctcctca

SEQ ID NO: 2188 - DNA, 330 bp, Homo sapiens
cagtctgccctgactcagcctgcctccgtgtctgggtctcctggacagtcgatcaccatctcctgcactggaaccagcagtgacgttggtggttatgactatgtctcctggtaccaacagcacccaggcaaagcccccaaactcatgatttatgatgtcagtaagcggccctcaggggtttctaatcgcttctctggctccaagtctggcaacacggcctccctgaccatctctgggctccagggtgaggacgaggctgattattactgcggctcatacacaagcagcagcacttgggtgttcggcggagggaccaagctgaccgtccta

SEQ ID NO: 2189 - DNA, 363 bp, Homo sapiens
caggtccagttggtacagtctggggctgaggtgaagaagcctggggcctcagtgaaggtctcctgcaaggtttccggatacaccctccctgaattatccatgcactgggtgcgacaggctcctggaaaagggcttgagtggatgggaggttttgatcctgaagatggtgaaacaatctacgcacagaagtttcagggcagagtcaccatgaccgaggacacatctacagacacagcctacatggagctgagcagcctgagatctgaggacacggccgtatattactgtgcaacatcggcagcaattctgaaagtcaactggttcgacccctggggccagggaaccctggtcaccgtctcctca

SEQ ID NO: 2190 - DNA, 336 bp, Homo sapiens
cagtctgccctgactcagcctgcctccatgtctgggtctcctggacagtcgatcaccatctcctgcactggaaccagcagtgacgttggtggttataactctgtctcctggtacctacaacacccaggcaaagcccccaaactcatgatttatgatgtcagtaagaggccctcaggggtttctaatcgcttctctggctccaagtctggcaacacggcctccctgaccatctctgggctccaggctgaggacgagggtgattattactgcagctcatatacaaacagcagcactctctgtgtggtattcggcggagggaccaagctgaccgtccta

SEQ ID NO: 2191 - DNA, 351 bp, Homo sapiens
gaggtgcagctggtggagtctgggggaggcttggtccagcctggggggtccctgagactctcctgtgcagcctctggattcaccgtcagtagaaactacatgacctgggtccgccaggctccagggaaggggctggagtgggtctcaattatttatagcggtggtagtacatactacgcagactccgtgaagggcagattcaccatctccagagacaattccaagaacacgctgtatcttcaaatgaacagcctgagagccgaggacacggctgtgtattactgtgcgagagatacattccatcggggagacgtctactggggccagggaaccctggtcaccgtctcctca

SEQ ID NO: 2192 - DNA, 324 bp, Homo sapiens
gacatccagatgacccagtctccatcctccctgtctgcttctgtaggagacagagtcaccatcacttgccaggcgagtcaggacattaacaactatttaaattggtatcagcagaaaccagggaaagcccctaagctcctgatctacgatgcatccaatttggaaacaggggtcccatcaaggttcagtggaagtggatctgggacagattttactttcaccatcagtagcctgcagcctgaagatattgcaacatattactgtcaacagtatggtaatctccctccgtacacttttggccaggggaccaagctggagatcaaa

SEQ ID NO: 2193 - DNA, 360 bp, Homo sapiens
gaagtgcagctggtggagtctgggggaggcttggtacagcctggcaggtccctgagactctcctgtgcagcctctggattcacctttgatgactatgccatgcactgggtccggcaagctccagggaagggcctggagtgggtctcaggtattagttggaatagtggtagcatagactatgcggactctgtgaagggccgattcaccatctccagagacaacgccaagaactccctgtatctgcaaatgaacagtctgagagctgaggacacggccttgtattactgtgcaaaagatcatttgggggagttatcgtctcccgactactggggccagggaaccctggtcaccgtctcctca

SEQ ID NO: 2194 - DNA, 330 bp, Homo sapiens
cagcttgtgctgactcaatcgccctctgcctctgcctccctgggagcctcggtcaagctcacctgcattctgagcagtgggcacagcagctacgccatcgcatggcatcagcagcagccagagaagggccctcggtacttgatgaagcttaacagtgatggcagccacagcaagggggacgggatccctgatcgcttctcaggctccagctctggggctgagcgctacctcaccatctccagcctccagtctgaggatgaggctgactattactgtcagacctggggcactgaggtggtattcggcggagggaccaagctgaccgtccta

SEQ ID NO: 2195 - DNA, 351 bp, Homo sapiens
gaggtgcaggtggtggagtctgggggaggcttggtccagcctggggggtccctgagactctcctgtgcagcctctggattcaccttcagtacctatgctatgcactgggtccgccaggctccagggaagggactggaatatgtttcaggtattagtagtaatgggggtagtacatattatgcaaactctctgaagggcagattcaccatctccagagacaattccaagaacacgctgtatcttcaaatgggcagtctgagagctgaagacatggctgtgtattactgtgcgagatctacgaacagggggttcgacccctggggccagggaaccctggtcaccgtctcctca

SEQ ID NO: 2196 - DNA, 339 bp, Homo sapiens
gacatcgtgatgacccagtctccagactccctggctgtgtctctgggcgagagggccaccatcaagtgcaagtccagccagagtgtcttatacagctccaacaataagaactacttagcttggtaccagcagaaaccaggacagcctcctaagtcgctcatttactgggcatctacccgggaatccggggtccctgaccgattcagtggcagcgggtctgggacagatttcactctctccatcagcagcctgcaggctgaagatgtggcagtttattactgtcaccaatattatagtagtccgtacacttttggccaggggaccaagctggagatcaaa

SEQ ID NO: 2197 - DNA, 351 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcaattatttatagcggtggtagcacattctacgcagactccgtgaagggcagattcaccatctccagagacagttccaagaacactctatatcttcaaatgagcagcctgagagccgaggacacggctgtgtattattgtgcgagagatctggactactacggtatggacgtctggggccaagggaccacggtcaccgtctcctca

SEQ ID NO: 2198 - DNA, 324 bp, Homo sapiens
gacatccagttgacccagtctccatccttcctgtctgcacctgtaggagacagagtcaccatcacttgccgggccagtcagggcattagtagttatttagcctggtatcagcaaaaaccagggaaagcccctaagctcctgatctatggtgcatccactttgcaaagtggggtcccatcaaggttcagcggcagtggatctgggacagaattcactctcacaatcagcagcctgcagcctgaagattttgcaacttattactgtcaacagcttaatagttaccagagattcactttcggccctgggaccaaagtggagatcaaa

SEQ ID NO: 2199 - DNA, 387 bp, Homo sapiens
gaagtgcagctggtgcagtctggagcagaggtgaaaaagcccggggagtctcttaagatctcctgtaagggttctggatacagctttaccagttactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagagggaatcgttgtagtggtggtagctgcctgaattactactacttctacggtatggacgtctggggccaagggaccacggtcaccgtctcctca

SEQ ID NO: 2200 - DNA, 333 bp, Homo sapiens
cagtctgccctgactcagcctgcctccgtgtctgggtctcctggacagtcgatcaccatctcctgcactggaaccggcagtgacgttggtggttataactatgtctcctggtaccaacaacacccaggcaaagcccccaaactcatgatttatgatgtcagtgagcggccctcaggggtttctaatcgcttctctggctccaagtctggcaacacggcctccctgaccatctctgggctccaggcggaggacgaggctgattattactgcagctcatatacaagcagcagcactctcgacgtgttcggcggagggaccaagctgaccgtccta

SEQ ID NO: 2201 - DNA, 381 bp, Homo sapiens
gaggtgcagctggtggagtctgggggaggcctggtcaagcctggggggtccctgagactctcctgtgcagcctctggattccccttcagtagctataccatgaactgggtccgccaggctccagggaaggggctggagtgggtctcatccattagtgggagtagtaattacatatactatgtagactcagtgaagggccgattcaccatctccagagacaacgccaagaactcactgtatctgcaaataaacagcctgagagccgaggacacggctgtctattactgtgcgagaagtgtgaggcattactatgatagtagtggttattaccccggggctatggacgtctggggccaagggaccacggtcaccgtctcctca

SEQ ID NO: 2202 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacatggccaggctcccaggctcctcatctatggtgcatccaccagggccactggtatcccagccaggttcagtggcagtgggtctgggacagagttcactctcaccatcagcggcctgcagtctgaagattttgcagtttattactgtcagcagtattataactggcctccgtacacttttggccaggggaccaagctggagatcaaa

SEQ ID NO: 2203 - DNA, 363 bp, Homo sapiens
caggtgcagctgcaggagtcgggcccaggactggtgaagccttcacagaccctgtccctcacctgcactgtctctggtggctccatcaacagtggtggttactactggagctggatccgccagcacccagggaagggcctggagtggattgggtacatctattacagtgggaccacctactacaacccgtccctcaagagtcgaattaccatatcagtagacacgtctaagagccagttctccctgaagctgagctctgtgactgccgcggacacggccgtgtattactgtgctagagtcaactttagcaggtcctggtactttgactactggggccagggaaccctggtcaccgtctcctcc

SEQ ID NO: 2204 - DNA, 324 bp, Homo sapiens
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcaataagcggccctcaggggtccctgatcgcttctctggctccaagtctggcaacacggcctccctgaccatctctgggctccaggctgaggatgaggctgattattactgctgctcatatgcaggcagctgggtgttcggcggagggaccaagctgaccgtccta

SEQ ID NO: 2205 - DNA, 375 bp, Homo sapiens
caggtgcagctgcaggagtcgggcccaggactggtgaagccttcggagaccctgtccctcacatgcactgtctctggtggctccatcagtagttactactggagctggatccggcagcccccagggaagggactggagtggattgggtatatcttttacagtgggagcaccaactacaacccctccctcaagagtcgagtcaccatatcattagacacgtccaagaaccagttctccctgaagctgagctctgtgaccgctgcggacacggccgtgtattactgtgcgacccaggagtatagtagctcgtccgccctcggctactactacggtttcgacgtctggggccaagggaccacggtcaccgtctcctca

SEQ ID NO: 2206 - DNA, 318 bp, Homo sapiens
tcctatgagctgactcagccaccctcagtgtccgtgtccccaggacagacagccaccatcacctgttctggagataaattgggggataaatatgcttgctggtatcagcagaagccaggccagtcccctgtgctggtcatctatcaagataccaagcggccctcagggatccctgagcgattctctggctccaactctgggaacacagccactctgaccatcagcgggacccaggctatggatgaggctgactattactgtcaggcgtgggacagcagcactgcggtattcggcggagggaccaagctgaccgtccta

SEQ ID NO: 2207 - DNA, 363 bp, Homo sapiens
caggtcaccttgagggagtctggtcctgcgctggtgaaacccacacagaccctcacactgacctgcaccttctctgggttctcactcagctctagtggaatgtgtgtgagctggatccgtcagcccccagggaaggccctggagtggcttgcgcgcattgattgggatgatgataaatactacagcacatctctgcagaccaggctcaccatctccaaggacacctccaaaaaccaggtggtccttacaatgaccaacatggaccctgtggacacagccacgtattactgtgcacggatctcagcaccagctggtctagggatcgacccctggggccagggaaccctggtcaccgtctcctca

SEQ ID NO: 2208 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcagtctcaccatcagcaatctgcaacctgaagattttgcaacttactactgtcaacagagttacagtaccccgtacacttttggccaggggaccaagctggagatcaaa

SEQ ID NO: 2209 - DNA, 396 bp, Homo sapiens
caggtgcagctgcaggagtcgggcccaggactggtgaagccttcacagaccctgtccctcacctgcactgtctctggtggctccatcagcagtggtgataactactggagttggatccgccagcccccagggaagggcctggaattgattgggtacatctattacagtgggaccacctactacaagccgtccctcaagagtcgacttaccatatcagtagacacgtccaagaaccagttctccctgaacctgagctctgtgactgccgcagacacggccgtgtattactgtgccagagttggacgtaccacgacgaaatacgatttttggaggggaactgaacttcaatactactttgactactggggccagggaaccctggtcaccgtctcctca

SEQ ID NO: 2210 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccaatttgcaaagtggagtcccatcaaggttcagtggctatggatctgggtcagatttcactctcaccatcagcagtctgcaacctgaagattttgcaacttactactgtcaacagagttacagtactcccccgtggacgttcggccaagggaccaaggtggaaatcaaa

SEQ ID NO: 2211 - DNA, 372 bp, Homo sapiens
caggtccagctggtgcagtctggggctgaggtgaagaagcctgggtcctcggtgaaggtctcctgcaaggcttctggaggcaccttcagcagctatgatatcagctgggtgcgacaggcccctggacaagggcttgagtggatgggaaggatcacccctattcttggtatagcaaattacgcacagaagttccagggcagagtcacgattaacgcggacaaatccacgagcacagcctacatggaactgagcagcctgaaatctgaggacacggccgtgtattactgtgcgaggacacgtggatatagtggctatggatccctgtggtactttgacttctggggccagggaaccctggtcaccgtctcctca

SEQ ID NO: 2212 - DNA, 333 bp, Homo sapiens
cagtctgtgctgacgcagccgccctcagtgtctggggccccagggcagagggtcaccatctcctgcactgggaacaactccaacatcggggctggttatgatgtacactggtaccagcagcttccacgaacagcccccaaactcctcatctatgttaacagcaatcggccctcaggggtccctgaccgattctctggctccaagtctggcacctcagcctccctggccatcactgggctccaggctgaggatgaggctgattattactgccagtcctatgacagcagcctgagtgatttggtgttcgggggagggaccaagctgaccgtccta

SEQ ID NO: 2213 - DNA, 360 bp, Homo sapiens
caggtccagctggtacagtctggggctgaggtgaagaagcctggggcctcagtgaaggtctcctgcaggatttccgattacaccctcactgaattatccatccactgggtgcggcaggctcctggaaaagggcttgagtggatgggaggttttgatcctgaagatggtgaaataatctacgcacagaagttccagggcagagtcaccatgaccgaggacacatctacagacacagcctacatggagctgagcagcctgagatctgaggacacggccgtgtattactgtgcaacagggggacagtggctggtacgttggttcgacccctggggccagggaaccctggtcaccgtctcctca

SEQ ID NO: 2214 - DNA, 330 bp, Homo sapiens
cagtccgccctgactcagcctgcctccgtgtctgggtctcctggacagtcgatcaccatctcctgcactggaaccagcagtgacgttggtggttataactatgtctcctggtaccagcaacacccaggcaaagcccccaaactcatgatttatgatgtcactaagcggccctcaggggtttctaatcgcttctctggctccaagtctggcaacacggcctccctgaccatctctgggctccaggctgaggacgaggctgattattattgcagctcatatacaagcagcaacactctcgtgttcggcggagggacccatctgaccgtcctc

SEQ ID NO: 2215 - DNA, 378 bp, Homo sapiens
caggtccagctggtgcagtctggggctgaggtgaagaagcctgggtcctcggtgaaggtctcctgcaaggcttctggaggcaccttgagcagctatactatcagctgggtgcgacaggcccctggacaagggcttgagtggatgggaaggatcatccctatccttggtatagcagactacgcacagaagttccagggcagagtcacgattaccgcggacaaatccacgaccacagcctacatggatctgagcagcctgggatctgaggacacggccttgtattattgtgcgagtgctccgaaggattggagctccggttttgactactactacggtatggacgtctggggccaagggaccatggtcaccgtctcctca

SEQ ID NO: 2216 - DNA, 339 bp, Homo sapiens
gatattgtgatgacccagactccactctctctgtccgtcacccctggacagccggcctccatctcctgcaagtctagtcagagcctcctgaatagtgatggaaagacctatttgtattggtacctgcagaaggcaggccagcctccacagctcctgatctatgaagtttccaaccggttctctggagtgccagaaaggttcagtggcagcgggtcagggacagatttcacactgaaaatcagccgggtggaggctgaggatgttggggtttactactgcatgcaaagtgtacaacttcctccgtacacttttggccagggcaccaagctggagatcaca

SEQ ID NO: 2217 - DNA, 357 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacaccatacgataactcggataaatgactactggggccagggaaccctggtcaccgtctcctca

SEQ ID NO: 2218 - DNA, 327 bp, Homo sapiens
cagtctgccctgactcagcctgcctccgtgtctgggtctcctggacagtcgatcaccatctcctgcactgcaaccagcagtgacgttggtgcttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatacacaagcagcagcacggtgttcggcggagggaccaagttgaccgtccta

SEQ ID NO: 2219 - DNA, 363 bp, Homo sapiens
gaggtgcagctggtggagtctgggggaggcttggtccagcctggggggtccctgagactctcctgtgcagcctctggattcaccttcagtacctatgctatgcactgggtccgccaggctccagggaagggactggaacatgtttcaggaattagtagtaatgggggtagcacatattatgcaaactctgtgaagggcagattcaccatctccagagacaattccaagaacacgttggatcttcaaatgggcagcctgagagctgaggacatggctgtgtattactgtgcgagatccctgtttttgagtggttatgtatactttgaatactggggccagggaaccctggtcaccgtctcctca

SEQ ID NO: 2220 - DNA, 336 bp, Homo sapiens
aattttatgctgactcagccccactctgtgtcggagtctccggggaagacggttaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcgccaatcttggaggggtgttcggcggagggaccaagctgaccgtccta

SEQ ID NO: 2221 - DNA, 363 bp, Homo sapiens
gaggtgcagctggtggagtctgggggaggcttggtccagcctggggggtccctgagactctcctgtgcagcctctggattcaccttcagtagctatgctatgcactgggtccgccaggctccagggaagggactggaatatgtttcaggcattagtagtaatgggggtagcacaaattatgcaaactctgtgaagggcagattcaccatctccagagacaattccaagaacacgctgtatcttcaaatgggcagcctgagagctgaggacatggctgtgtattactgtgcgagatccctgtttttgagtggttttgtgtactttgacacctggggccagggaaccctggtcaccgtctcctca

SEQ ID NO: 2222 - DNA, 336 bp, Homo sapiens
aattttatgctgactcagccccactctgtgtcggagtctccggggaagacggtaaccatttcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatggcaacaatcatggaggggtgttcggcggagggaccaagctgaccgtccta

SEQ ID NO: 2223 - DNA, 381 bp, Homo sapiens
caggtgcatctggtggagtctgggggaggcgtggtccagcctgggaggtccctgagactctcctgtgcagcctctggcttcaccttcagtaactatggcatgcactgggtccgccaggctccaggcaaggggctggagtgggtggcagttatctcagctgatgagaataataaattctatgcaagctccgtgaagggccgattcaccatctccagagacaattcgaagaacacgttgtatttgcaaatgaacagtctgagaactgaggacacggctcgatattactgtgcgaaagggggggataacagtggctgggcctgggacggtgataaccccccgacggactactggggccagggaaccctggccatcgtctcttca

SEQ ID NO: 2224 - DNA, 339 bp, Homo sapiens
gacatcgtgatgacccagtctccggacttcctggctgtgtctctgggcgagagggccaccatcaactgcaagtccagtcagagtgttttttacacccccaagaataagagctacttagcttggtacaagcagaaaccaggacagcctcctaaggtgctcttttactgggcatctacccgggaatccggggtccctgagcgattcagtggcagcgggtctgggacagatttcactctcatcatcagcagcctgcaggctgaggatgcggcagtttattactgtcagcaatattatactgctcctctcaccttcggcggtgggaccaaggtggagatcaag

SEQ ID NO: 2225 - DNA, 369 bp, Homo sapiens
gaggtgcaactattggagtctgggggaggcttggttcagccgggggggtccctgagactctcctgtgcagcctctggattcacattcagcagttatgtcctgagttgggtccgccagggtccagggagggggctggagtgggtctcaagtatcagtggtagtggtggtgagacatattatgcagactccgtgaagggccggttctccatctccagagacaattctaagaatacgctggatctgcacatgaacagcctgagagccgaggacacggccgtctatttctgtgccagagatcgcgactgggaggcactacgttcggagtatttcgatctctggggccgtggcaccctggtcagtgtctcctca

SEQ ID NO: 2226 - DNA, 321 bp, Homo sapiens
gacattgtgttgacacagtctccagccaccctgtctttgtctccaggggaaagagccaccctctcctgcagggccagtcactttatgcacagtaacttagcctggtatcaacagaaacttggccaggcccccaggctcctcatctatgatgcggccagtagggccgccggcatcccacccaggttcagaggcagcgggtctgggacagacttcactctcaccatcagcagcctggagcctgaagattttgcagtttattactgtcagcagcgtagcagctggcctcggactttcggcggagggaccaaggtggagatcaaa

SEQ ID NO: 2227 - DNA, 357 bp, Homo sapiens
gaggtgcagctggtggagtctgggggaggcttggtccagccgggggggtccctgagactctcctgtgcagccactggattcacgtttaataattattggatgacctgggtccgccaggctccagggaaggggctggagtgggtggccagtataaaccaagatgggactgagaaatacaatgtggactctgtgaagggccgattcaccatctccagagacaaccgcaagaactcacaatatctgcaaatgaacagcctgagagccgaggacacggctgtgtattactgtgcgagagtgggtatccggagcaggtctctcacgtactggggccagggtaacctggtcaccgtctcctca

SEQ ID NO: 2228 - DNA, 321 bp, Homo sapiens
gacatccagatgacccagtctccatcctccctgtctgcatttgtcggagacagagtcaccatcacttgccggacaagtcagagcattagcaactatttacattggtatcagcagaaaccagggaaagcccctaggctcctgatctatggtgcatccagtttgcaaagtggggtcccatcaaggttcagtggcagtggatctgggacagacttcactctcaccatcagcagtctgcaacctgaagattttgcaacttactactgtcaacagacttacagtacccttaccactttcggccctgggaccaaagtggatatcaaa

SEQ ID NO: 2229 - DNA, 375 bp, Homo sapiens
caggtgcagctgcaggagtcgggcccaggactggtgaagccttcacagaccctgtccctcacctgcactgtctctggtggctccatcagtagtggtgattactactggagttggatccgccagcccccagggaagggcctggagtggattgggtacatctattacagtgggagcacctactacaacccgtccctcaagagtcgagttaccatgtcactagacacgtccaagaaccagttctccctgaagctgagctctgtgactgccgcagacacggccgtgtattactgtgccagaggccaaatttacgactacagggggagtgggtggtggttcgacccctggggccagggaaccctggtcaccgtctcctca

SEQ ID NO: 2230 - DNA, 318 bp, Homo sapiens
gaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatacaatagggccactggcatcccagccaggttcagtggcagtgggtctgggacagacttcactctcaccatcagcagcctagagcctgaagattttgcagtttattactgtcagcagcgtagcaactggagcaccttcggccaagggacacgactggagattaaa

SEQ ID NO: 2231 - DNA, 354 bp, Homo sapiens
caggtgcagctgcaggagtcgggcccaggactggtgaagccttcacaggccctgtccctcacctgcactgtctctggtggctccataagaagtggcagttattattggaactggatccggcagcccgccgggaagggactggagtggattggccgtatctattccagtgggagcaccagttacaacccctccgtcaagggtcgagtcacgatgtcagtagacacgtccacgaaccaggtcttcctcaacctgacctcagtggccgcctcagacacggccgtgtattactgtgcgagagctcgctttaccggcatggatgtctggggccaagggactccggtcaccgtctcctca

SEQ ID NO: 2232 - DNA, 321 bp, Homo sapiens
gacatccagatgacccagtctccatcctccctctatgcatctgtcggagacagagtcaccatcacttgccgggcaagtcagaccgttagcacctatttaaattggtatcagcagaaatcagggaaagcccctaagctcctgctctacgctgcatccactttgcaaagtggggtcccgtcaagattcagtggcagtgggtctgggacagatttcactctcaccatcagcagtctgcaacctgacgattttgcaacttactactgtcaacagagtcttactccgcctctcactttcggccctgggaccaaagtggatatcaaa

SEQ ID NO: 2233 - DNA, 390 bp, Homo sapiens
caggtgcagctggtggagtctgggggaggcgtggtccagcctgggaggtccctgagactcccctgtgcagcctctggattcaccttcagtagctatgatatgcactgggtccgccaggctccaggcaaggggctggagtgggtggcagttatttcatatgatggaaggaataaattctacgcagactccgtgaggggccgattcaccatctccagagacaattcaaagaacacgctgtttcttcaaatgaacagcctgagagctgaggacacggctgtgtattactgtgcgagagatttgggtatagcagcaactggtatatcagacgattacttctacttctacggtatggacgtctggggccaagggaccacggtcaccgtctcctca

SEQ ID NO: 2234 - DNA, 324 bp, Homo sapiens
tcctatgagctgacacagccaccctcggtgtcagtgtccccaggacagacggccaggatcacctgctctggagatgcattgccaaagcaatatgcttattggtaccaacagaagccaggccagacccctgtcctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatcgggtattcggcggagggaccaagctgaccgtccta

SEQ ID NO: 2235 - DNA, 372 bp, Homo sapiens
caggtgcagctgcaggagtcgggcccaggactggtgaagccttcggagaccctgtccctcacctgcactgtctctggtggctccatcagtagttactcctggacctggattcggcagcccccaggtcagggactggagtggattggctatatcttttacagtgggagcaccaactacaacccctccctcaagagtcgagtcaccatatctctagacacgcccaagaaccagttctccctgaggctgagctctgtgaccgctgcggacacggccgtgtattactgtgcgagtgtggggggtgtagagatggctacaatttccttctacggtatggacgtctggggccaagggaccacggtcaccgtctcctca

SEQ ID NO: 2236 - DNA, 318 bp, Homo sapiens
tcctatgagctgactcagccaccctcagtgtccgtgtccccaggacagacagccagcatcacctgctctggagatagattgggggataaatatgcttgctggtatcaacagaagccaggccagtcccctgtcctggtcatctatcaagataacaagcggccctcagggatccctgagcgattctccggctccaactctgggaacacagccactctgaccatcagcgggacccaggctatggatgaggctgactatcactgtcaggcgtgggacagcagtaatgtggtattcggcggagggaccaagctgaccgtccta

SEQ ID NO: 2237 - DNA, 363 bp, Homo sapiens
caggtgcagctggtggagtctgggggaggcgtggtccagcctgggaggaccctgagactctcctgtgcagcctctggattcgccttcagtagctatgctatgcactgggtccgccaggctccaggcaaggggctggagtgggtggcagttatatcatctgatgaaagtaataaatactacgcagactccgtgaagggccgattcaccatctccagagacaattccaagagcacgctgtatctgcaagtgaacaccctgagacctgaggacacggctgtgtattactgtgcgagagatcggttgggtatagtggctcctcgccctgactactggggccagggaaccctggtcaccgtctcctca

SEQ ID NO: 2238 - DNA, 324 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggaaagattttactttcaccatcagcagcctgcagcctgaagatattgcaacatattactgtcaacagtatgataatctccccccattcactttcggccctgggaccaaagtggatatcaaa

SEQ ID NO: 2239 - DNA, 366 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcacgcattgattgggatgatgataaatactacagcacatctctgaagaccaggctcaccatctccaaggacacctccaaaaaccaggtggtccttacaatgaccaacatggaccctgtggacacagccacgtattactgtgcacggatagggatcgggtggttccgttggggtatggacgtctggggccaagggaccacggtcaccgtctcctca

SEQ ID NO: 2240 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatatacaagcagcagcacttgggtgttcggcggagggaccaagctgaccgtccta

SEQ ID NO: 2241 - DNA, 363 bp, Homo sapiens
caggttcaactggtgcagtctggagctgaggtgaagaagcctggggcctcagtgaaggtctcctgcaaggcttctggtttcccctttaccagctatggtctcagctgggtgcgacaggcccctggacaggggcttgagtggatgggatggatcagcggttacaatggtaacacacactatgcacagaagctccagggcagagtcaccatgtccacagacacatccacgagcacagcccacatggagctgaggaacctgagatcagacgacacggccgtgtattactgtgcgagacaggagggatattttgattggttgtactttgccaactggggccagggaaccctggtcaccgtctcctca

SEQ ID NO: 2242 - DNA, 330 bp, Homo sapiens
cagtctgtgttgacgcagccgccctcagtgtctgcggccccaggacagaaggtcaccatctcctgctctggaagcaactccaacattgggaatagttatgtatcctggtaccagcagctcccaggaacagcccccaaagtcctcatttatgacaataataagcgaccctcagggattcctgaccgattctctggctccaagtctggcacgtcaggcaccctgggcatcaccggactccagactggggacgaggccgagtattactgcgcaacatgggatagcagcctgagtgctgtggtattcggcggagggaccaagctgaccgtccta

SEQ ID NO: 2243 - DNA, 363 bp, Homo sapiens
caggtgcagctggtggagtctgggggaggcgtggtccagcctgggaggtccctgagactctcctgtgcagcctctggattcaccttcagtacatatgctatccactgggtccgccaggctccaggcaaggggctggagtgggtggcagttatatcatatgatggaagtaataaatactacgcaaagtccgtgaagggccgattcaccatctccagagacaattccaaaaacacgctatatctgcaaatgaacagcctgggagctgaggacacggctgtgtattactgtgcgagagcacaatttgggaactactactacggtatggacgtctggggccaagggaccacggtcaccgtctcctca

SEQ ID NO: 2244 - DNA, 327 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatatacaagcaccttttatgtcttcggaactgggaccaaggtcaccgtccta

SEQ ID NO: 2245 - DNA, 375 bp, Homo sapiens
caggtgcagctggtggagtctgggggaggcgtggtccagcctgggaggtccctgagactctcctgtacagcctctggattcaccttcagtacctatgctatagactgggtccgccaggctccaggcagggggctggagtgggtggcagttatatcacatgatggaggtaataaatactatgcagactccgtgaagggccgattcaccatctccagagacaattccaagaacacgctgtatctgcaaatgaacagcctgagagctgaggacacggctgtatattactgtgcgagagagctgagatgggcagtaccatcctgggacgggggctactttgactactggggtcagggaaccctggtcaccgtctcctca

SEQ ID NO: 2246 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacaatacccctccctacacttttggccaggggaccaagctggagatcaaa

SEQ ID NO: 2247 - DNA, 381 bp, Homo sapiens
gaagtgcagctggtggagtctgggggaggcgtggtacagcctggggggtccctgagactctcctgtgcagcctctggattcacctttgatgattatgccatgcactgggtccgtcaagctccagggaagggtctggagtgggtctctcttattagtgggaatggtgttagtacatactatgcagactctgtgaagggccgattcaccatctccagagacaacagcaaaaactccctgtatctgcaaatgaacagtctgagaactgaggacaccgccttgtattactgcgcaagagatactgggggagtgtatgctgcactgtactactactactacggtatggacgtctggggccaagggaccacggtcaccgtctcctca

SEQ ID NO: 2248 - DNA, 330 bp, Homo sapiens
cagtctgtgctgactcagccaccctcagcgtctgggacccccgggcagagggtcaccatctcttgttctggaagcaactccaacatcggaagtaatactataaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtgtggtattcggcggagggaccaagctgaccgtccta

SEQ ID NO: 2249 - DNA, 396 bp, Homo sapiens
caggtccagctggtacagtctggggctgaagtgaagacgcctggggcctcagtgaaggtctcctgcaaggtttccggatacaccctcactgaattatccatgcactgggtgcgacaggctcctggaaaagggcttgagtggatgggaggttttgatcctgaagatgctgaaacaatctacgcacagaagttccaggggagagtcacaatgaccgaggacacatctacagacacagcctacatggagctgagcagcctgagatctgaggacacggccgtgtattactgtgcaacagcccctcctattgtaggagtaccaggtgccatcaatcgggattactactactactacggtatggacgtctggggccaagggaccacggtcaccgtctcctca

SEQ ID NO: 2250 - DNA, 336 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagacctctaatttataagatttctaatcggttctctggggtcccagacagattcagtggcagtggggcagggacagatttcacactgaaaatcagcagggtggaagctgaggatgtcggggtttattactgcatgcaagctacacaatttccttacacttttggccaggggaccaagctggagatcaaa

SEQ ID NO: 2251 - DNA, 396 bp, Homo sapiens
caggtcaccttgagggagtctggtcctgcgctggtgaaacccacacagaccctcacactgacctgcaccttctctggattctcactcagcactagtggaatgtgtgtgagttggatccgtcagcccccagggaaggccctggagtggcttgcacgcatcgattgggatgatgataaatactacagcacatctctgaagaccaggctcaccatctccaaggacacctccaaaaaccaggtggtccttacaatgaccaacatggaccctgtggacacagccacgtattactgtgcacggataaatgcagcagtgcctggccggccctggggctatgacaagctgagttattacggtatggacgtctggggccaagggaccacggtcaccgtctcctca

SEQ ID NO: 2252 - DNA, 327 bp, Homo sapiens
gaaattgtgttgacgcagtctccaggcaccctgtctttgtctccaggggaaagagccaccctctcctgcagggccagtcagagtgttagcagcggctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtatttctgtcagcagtatggtagctcacctctgtacacttttggccaggggaccaagctggagatcaaa

SEQ ID NO: 2253 - DNA, 366 bp, Homo sapiens
caggtccagctggtacaatctggggctgaggtgaagaagcctggggcctcagtgaaggtctcctgcaaagtttccggatacaccctccctgaattatccatccactgggtgcgacaggctcctggacaagggcttgagtggctgggaggttttgatcctgaagatggtgaaacaatctacgcacagaagttccagggcagagtcaccatgaccgaggacacatctacagacacagcctacatggagttgagcagcctgagatctgaggacacggccgtgtattactgtgcaaccgcccctcctatagcagcagctggtacctggttcgacccctggggccagggaaccctggtcaccgtctcctca

SEQ ID NO: 2254 - DNA, 333 bp, Homo sapiens
cagtctgtgctgactcagccaccctcagcgtctgggacccccgggcagagggtcaccatctcttgttctggaagcagctccaacatcggaactaattatgtatactggtaccagcagctcccaggaacggcccccaaactcctcatctataataataatcagcggccctcaggggtccctgaccgattctctggctccaagtctggcacctcagcctccctggccatcagtgggctccggtccgaggatgaggctgattattactgtgcagcatgggatgacagcctgactggtcgttatgtcttcggaactgggaccaaggtcaccgtccta

SEQ ID NO: 2255 - DNA, 378 bp, Homo sapiens
caggtgcagctgcaggagtcgggcccaggactggtgaagccttcggagaccctgtccctcacctgcactgtctctggtgactccatcagtaattactactggagctggatccggcagcccgccgggaagggactggagtggattgggcgtatctatgccagtgggagcaccaactacaacccctccctcaagagtcgagtcaccatgtcactagacacgtccaagaaccacttctccctgaagctgagctctgtgaccaccgcagacacggccgtgtattactgtgcgaaagatgccgtactttattactttggttcggggagttactccaactggttcgacccctggggccagggaaccctggtcaccgtctcctca

SEQ ID NO: 2256 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatgctaacggcaatcggccctcaggggtccctgaccgattctctggctccaagtctggcacctcagcctccctggccatcactgggctccaggctgaggatgaggctgattattactgccagtcctatgacagcagcctgagtggttcgagggtgttcggcggagggaccaagctgaccgtccta

SEQ ID NO: 2257 - DNA, 381 bp, Homo sapiens
gaggtgcagctggtggagtctgggggaggcctggtcaagcctggggggtccctgagactctcctgtgaagcctctggattcagcttcagtacctatagcatgaactgggtccgccaggctccagggaaggggctggagtgggtctcatccactagtagtagtagtagtcacatatattatgcagactcagtgaagggccgattcagcatctccagagacaacgccaagaactcactgtatctgcaaatgaacagcctgagagccgaggatacggctgtgtattactgtgcgagagattaccgacggtatagtgggagccactcggccccctggcatgcttttgatatctggggccaagggacaatggtcaccgtctcttca

SEQ ID NO: 2258 - DNA, 336 bp, Homo sapiens
gaaattgtgatgacccagactccactgtctctgtccgtcacccctggacagccggcctccatctcctgcaagtctactcagagcctcctgcatagtgatggaaagacctatttgtattggtacctgcagaaggcaggccagcctccacagctcctgatctatgaagtttccaaccggttctctggagtgccagataggttcagtggcagcgggtcagggacagatttcacactgaaaatcagccgggtggaggctgaggatattggggtttattactgcatgcaaagtatacagctgcctgggacttttggccaggggaccaagctggagatcaaa

SEQ ID NO: 2259 - DNA, 366 bp, Homo sapiens
gaagtgcagctgttggagtctgggggaggctcggcacagcctggggggtccctgagactctcctgtgcagcctctggattcatctttagcagatatgccatgagttgggtccgccaggctccagggaaggggctggagtggatctcaggtattagtggtggtggtgatagtacatataacgcagactccgtgaagggccggttcaccatctccagagacaattccaagaacacgctgtatctgcaaatgagtagcctgagagtcgaggacacggccgtatattactgtgcgaaagacgaccgggaggacaagtcgtgggggtaccccgaatactggggccagggaaccctggtcaccgtctccgca

SEQ ID NO: 2260 - DNA, 336 bp, Homo sapiens
caggttgtgctgactcaatcgccctctgcctctgcctccctgggagcctcggtcaagctcacctgcactctgagcagtgggcacagcagctacgccatcgcatggcatcagcagcagccagagaagggccctcgattcttgatgaaacttaacggtgatggcagccacagggacggggacgggcttcctgatcgcttctcaggctccagctctggggctgagcgctacctcaccatctctagcctccagtctgaggatgaggctgactattactgtcagacctggggcactgcctatggaggcgtattcggcggagggaccaagctgaccgtccta

SEQ ID NO: 2261 - DNA, 363 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaggtttctgaaacaatctacgcacagaagttccagggcagagtcaccatgaccgaggacacatctacagacacagcctatatggagctgagcagcctgagatctgaggacacggccgtgtattactgtgcaatagcccccgctatggtgactactggatggttcgacccctggggccagggaaccctggtcaccgtctcctca

SEQ ID NO: 2262 - DNA, 330 bp, Homo sapiens
cagtctgccctgactcagcctgcctccgtgtctgggtctcctggacagtcgatcaccatctcctgcactggagccagcagtgtcgttggtgcttataactttgtctcctggtaccaacaacacccaggcaaggcccccaaactcatggtttatcatgtcagtgagcggccctcgggggtttctcatcgcttctctggctccaagtctggcaacacggcctccctgaccatctctgggctccaggctgaggacgaggctgattattactgcagctcatatacaggcagcagcacttgggtgttcggcggagggaccaagctgaccgtccta

SEQ ID NO: 2263 - DNA, 372 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtataccaaactacgcacagaagttccagggcagagtcacgattaccgcggacaaatccacgagcacagcctacatggagctgagcagcctgagatctgaggacacggccgtgtattactgtgcgctagtagcaccagctgacgcctactcctactactacgctatggacgtctggggccaagggaccacggtcaccgtctcctca

SEQ ID NO: 2264 - DNA, 321 bp, Homo sapiens
cagtctgtgctgactcagccaccctcagcgtctgggacccccgggcagagggtcaccatctcttgttctggaagcagctccaacatcggaagtaattatgtatactggtaccagcagctcccaggaacggcccccaaactcctcatctatagtaataatcagcggccctcaggggtccctgaccgattctctggctccaggtctgccacctcagcctccctggccatcagtgggctccggtccgaggatgaggctgcttattactgtgcagtatgggatgacagcctggtgttcggcggagggaccaagctgaccgtccta

SEQ ID NO: 2265 - DNA, 363 bp, Homo sapiens
caggtgcagctggtggagtctgggggaggcgtggtccagcctgggaggtccctgagactctcctgtgcagcctctagattcaccttcaatagctatgctatgcactgggtccgccaggctccaggcaaggggctggagtgggtggcagttatatcatatgatggaagtaataaatactacgcagactccgtgaagggccgattcaccatctccagagacaattccaagaatacgctgtatctgcaaatgaacagcctgagagctgaggacacggctgtttattactgtgcgagagatggtagtgggagctactggggtccggttgactactggggccagggaacccaggtcaccgtctcctca

SEQ ID NO: 2266 - DNA, 324 bp, Homo sapiens
gaagttgtgttgacacagtctccagccaccctgtctttgtctccaggggaaagagccaccctctcctgcagggccagtcagagtgttagcagctacttaggctggttccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttatttctgtcagcagcgtagcaactggcctccaatcaccttcggccaagggacacgactggagattaaa

SEQ ID NO: 2267 - DNA, 375 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatgtctattacagtgggagcaccaactacaacccctccctcaagagtcgagtcaccatgtcagttgacacgtccaagaaccagttctccctgaagctgagctctgtgaccgctgcggacacggccgtgtattactgtgcgggcgatttttggagtgattatgggggggcctactattacttcggtatggacgtctggggccaagggaccacggtcaccgtctcctca

SEQ ID NO: 2268 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaaactcctgatctatgctgcatccactttgcaaagtggggtcccatcaaggttcagcggcagtgggtctgggacagatttcactctcaccatcagcagcctgcagcctgaagattttgcaacttactattgtcaacagactaacagtttcccccggacttttggccaggggaccaagctggagatcaag

SEQ ID NO: 2269 - DNA, 375 bp, Homo sapiens
caggtccagctggtacagtctggggctgaggtgaagaagcctggggcctcagtgacggtctcctgcaaggtttccggattcaccctcactgaattatccatccactgggtgcgacaggctcctggaaaagggcttgagtggatgggaggttttgatcctgaagatggtgaaacaatctacgcacagaagttccagggcagagtcaccatgaccgaggatacatctacagacacagcctacatggagctgagcagcctgagatctgaggacacggccatttattactgtgtaacacatcggggtatggggatagcagctcgccattacaactggttcgacccctggggccagggaaccctggtcatcgtctcctca

SEQ ID NO: 2270 - DNA, 330 bp, Homo sapiens
cagtctgtgttgacgcagccgccctcagtgtctgcggccccaggacagaaggtcaccatctcctgctctggaaccagctccaacattgggaatgattatgtgtcctggtaccagcacctcccaggaacagcccccaaactcctcatttatgacaataataagcgaccctcagggattcctgaccgattctctggctccaagtctggcacgtcaggcaccctgggcatcaccggactccagactggggacgaggccgaatattactgcgcaacatgggatagcagcctgagtgctgtgcttttcggcggagggaccaagctgaccgtccta

SEQ ID NO: 2271 - DNA, 375 bp, Homo sapiens
gaggtgcagctggtggagtctgggggaggcctggtcaagcctggggggtccctgagactctcctgtgcagcctctggattcatgttcagtagctatagcatgaattgggtccgccaggctccagggaaggggctggagtgggtctcatacattagtagtagtagtagttacatatactacgcagactcagtgaagggccgattcaccatctccagagacaacgccaagaactcactgtatctgcaaatgaacagcctgagagccgaggacacggctgtgtattactgtgcgggggaccagggagtgggaggtacttacaactactactacggtatggacgtctggggccaagggaccacggtcaccgtctcctca

SEQ ID NO: 2272 - DNA, 318 bp, Homo sapiens
tcctatgagctgactcagccaccctcagtgtccgtgtccccaggacagacagccagcatcacctgctctggagataagttgggggataaatatgtctcctggtatcagcagaagccaggccagtcccctgtgttggtcatctatcaagataccaagcggccctcagggatccctgagcgattctctggctacaactctgggaacacagccactctgaccatcagcgggacccaggctatggatgaggctgactattactgtcaggcgtgggacagcagtcatgtggtattcggcggagggaccaagctgaccgtccta

SEQ ID NO: 2273 - DNA, 369 bp, Homo sapiens
caggtccagctggtacagtctggggctgaggtgaagaagcctggggcctcagtgaaggtctcctgcaaggtttccggatacaccctccctgaattatccatgcactgggtgcgacaggctcctggaaaagggcttgagtggatgggaggttttgatcctgaggatggtgacacaatctacgcacagaggttccggggcagagtcaccatgaccgaggacacatctacagacacagcctacatggagctgagcagcctgagatctgacgacacggccgtgtattactgtacaacaacaacccccttcggtgaccatggcccagggtggttcgacccctggggccagggaaccctggtcaccgtctcctca

SEQ ID NO: 2274 - DNA, 321 bp, Homo sapiens
gacatccagatgacccagtctccatcttccgtgtctgcatctgtcggagacagagtcaccatcacctgtcgggcgagtcagggtcctagcaactatataggctggtatcagcagaaaccagggaaagcccctaaactcctgatctatgctgcatccactttgcaaactggggtcccatcaaggttcagcggtagtggatctgggacagatttcactctcaccatcagcagcctgcagcctgaagattttggaacttactattgtcaacagggtaagaacttccctctcactttcggccctgggaccaaggtggatatcaaa

SEQ ID NO: 2275 - DNA, 357 bp, Homo sapiens
caggtgcagctgcaggagtcgggcccaggactggtgaagccttcggggaccctgtccctcacctgcgttgtctctggtggctccatcagcagtagtaactggggttgggtccgccagcccccagggaaggggctggagtggattggggaaatctaccttagtgggaccaccaactacaacccgtccctcacgagtcgagtcaccatatcagtcgacaagtccaagaaccagttctccctgaagctgaactctatgaccgccgcggacacggccatatattactgtgcgagaccaacagctggggccggcggggcttttgatatctggggccaagggacaatggtcaccgtctcttca

SEQ ID NO: 2276 - DNA, 330 bp, Homo sapiens
cagtctgtactgactcagccaccctcagcgtctgggacccccgggcagagggtcaccatctcttgttctggaagcaactccaaaatcggagtttattctgtaaactggtaccagcaactcccaggaacggcccccaaactcctcatctataggaatagtcagcggccctcaggggtccctgaccgattctctggctccaagtctggcacctcagcctccctggccatcagtgggctccagtctgaggatgaggctgattattattgttcagtatgggatgacagcctgaatggtccactgttcggcggagggacgaagctgaccttccta

SEQ ID NO: 2277 - DNA, 360 bp, Homo sapiens
gaagtgcagctggtggagtctgggggaggcgtggtacagcctggggggtccctgagactctcctgtgcagcctctggattcacctttaatgattatgccatgcactgggtccgtcaacctccagggaagggtctggagtgggtctctcttattagtggggatggtgataacacatactatgcagactctatgaagggccgattcaccatctccagagacaacagcaaaaactccctgtatctgcaaatgaacagtctgagaactgaggacaccgccttctattactgtacaacattatacatttgggggatccggccgggggacttctggggccagggaaccctggtcaccgtctcctca

SEQ ID NO: 2278 - DNA, 333 bp, Homo sapiens
gatgttgtgatgactcagtctccactctccctgcccgtcactcttggacagccggcctccatctcctgcaggtctagtcaaagcctcgtatacactgatggaaacacctacttgaattggtttcagcagaggccaggccaatctccaaggcgcctaatctataaggtttctaaccgggactctggggtcccagacagattcagcggcagtgggtcaggcactgatttcacactgaaaatcagcagggtggaggctgaggatgttggggtttattactgcatgcaaggtacacactggtacacttttggccaggggaccaagctggagatcaaa

SEQ ID NO: 2279 - DNA, 378 bp, Homo sapiens
caggtgcagctgcaggagtcgggcccaggactggtgaagccttcacagaccctgtccctcacctgcactgtctctggtgactccatcagtagtggtagtttctattggagttggatccggcagcccgccgggaagggactggagtggattgggcgtatctatagcagtgggagcaccgactacaacccctccctcaagagccgggtcaccatatcaggagacacgtccaagaaccagttctccctgaagctgacctctgtgaccgccgcagacacggccgtatattattgtgcgagagaatcagtcgactacagtcagtactactattacaacggtatggacgtctggggccaagggaccacggtcatcgtctcctca

SEQ ID NO: 2280 - DNA, 330 bp, Homo sapiens
gaaattgtgttgacgcagtctccaggcaccctgtctttgtctccaggggaaagagccaccctcttctgcagggccagtgaaattgttagcagcagctacttagcctggtaccagcagaaacctggccaggctcccaggctcctcatctatggtgcatccagcagggccactggcatcccagacaggttcagtggcagtgggtctgggacagacttcactctcaccatcatcagactggagcctgaagattttgcagtgtattactgtcagcagtatggtagctcccctccagagctcactttcggccctgggaccaaagtggatatcaaa

SEQ ID NO: 2281 - DNA, 393 bp, Homo sapiens
cacgtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggatataataaatattacgcagactccgtgaagggccgattcaccatctccagagacaattccaagaacacgctgtatctgcaaatgaacagcctgagagctgaggacacggctatatactactgtgcgagaggccagcgcggtagtggttattcccacctggagggtctcacttactactaccacggtatggacgtctggggccaagggaccacggtcaccgtctcctca

SEQ ID NO: 2282 - DNA, 336 bp, Homo sapiens
gatattgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctaatcgggcctccggggtccctgacaggttcagcggcagtggatcaggcacagattttacactgaaaatcagcagagtggaggctgaggatgttggggtttattactgcatgcaagctctacaaactccgtacacttttggccaggggaccaagctggagatcaaa

SEQ ID NO: 2283 - DNA, 381 bp, Homo sapiens
gaggtgcagctggtggagtctgggggaggcctggtcaagcctggggggtccctgagactctcctgtgcagcctctggattcactttcagtagccatatcatgaactgggtccgccaggctccagggaaggggctggagtgggtctcatccattagtactagtagtaattacatatactatgtagactcactgaagggccgattcaccatctccagagacaacgccaagaactcactgtatctgcaaatgaacagcctgagagccgaggacacggctgtgtattactgtgcgagaagtgtgaggcattactatgatagtactggttattatcccggggctatggacgtctggggccaagggaccacggtcaccgtctcctca

SEQ ID NO: 2284 - DNA, 324 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccagcctcctcatctatggtgcatccaccagggccactggtatcccagccaggttcagtggcagtgggtctgggacagagttcactctcaccatcagcagcctgcagtctgaagattttgcagtttattactgtcagcactattataactggcctccgtacacttttggccaggggaccaagctggagatcaaa

SEQ ID NO: 2285 - DNA, 366 bp, Homo sapiens
gaggtgcagctgttggagtctgggggaggcttggtacagcctggggggtccctgagactctcctgtgcagcctctggattcacctttagcagctatggcatgagctgggtccgccaggctccagggaaggggctggagtgggtctcaactattagtggtagtggtggtagcacatactacgcagactccgtgaagggccggttcaccatctccagagacaattccaagaagacgctgtatctgcaaatgaacagcctgagacccgaggacacggccgtctattactgtgcgaaacttacgtttggggacctagaacgcctggggtgggactactggggccagggaaccctggtcaccgtctcctca

SEQ ID NO: 2286 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccacgactgtgatctttgaggataaccaaagaccctctggggtccctgatcggttctctggctccatcgacagctcctccaactctgcctccctcaccatctctggactgaagactgaggacgaggctgactactactgtcagtcttatgatggctacaattcaggggcagtgttcggcggagggaccaagctgaccgtccta

SEQ ID NO: 2287 - DNA, 375 bp, Homo sapiens
gaggtgcagctggtggagtctgggggaggcttggtccagcctggggggtccctgagactctcctgtgcagcctctggattcacctttagtagctattggatgagctgggtccgccagcctccagggaaggggctggagtgggtggccaacataagacaagatggaagtgagaaacactatgcggactctatgaagggccgattcaccatctccagagacaacgccaagaactcactgtatctgcaaatgaacagcctgagagccgaggacacggctgtgtattactgtacgagagacttccgctatagttcggggagttattttgattttgtcaggggctactggggccagggaaccctggtcaccgtctcctca

SEQ ID NO: 2288 - DNA, 333 bp, Homo sapiens
cagtctgtgctgacgcagccgccctcagtgtctggggccccagggcagagggtcaccatctcctgcactgggagcagctccaacatcggggcaccttatgatgtacactggtaccagcaacttccaggaacagcccccaaactcctcatctataataacaccaatcggccctcaggagtccctgaccgattctctggctccaagtctggcacctcagcctccctggccatcactgggctccaggctgaggatgaggctgattattactgccagtcctatgacagcagcctgagtggttgggtgttcggcggagggaccaagctgaccgtccta

SEQ ID NO: 2289 - DNA, 351 bp, Homo sapiens
gaggtgcagctggtggagtctgggggaggcatggtacagccagggcggtccctgagactctcctgtacagcttctggattcagctttggtgattttgctatgagctgggtccgccaggctccagggaagggactggagtgggtagggttcattagaagcaaagctaaaggtgggacaacagaatatgccgcgtctgtgaaaggcagattcaccatctcaagagatgattctaaaagtgtcgcctatctgcaaatgaacagcctgaaagccgaggacacagccctctattattgtaagaacgcagatgctagtcagtactggggccagggaaccctggtcaccgtctcctca

SEQ ID NO: 2290 - DNA, 339 bp, Homo sapiens
gacatcgtgatgacccagtctccagactccctggctgtgtctctgggcgagaggaccaccatcagttgcaagtccagccagagtgttttacacagctccaacaataagaactacttagcttggtaccagcagaaaccaggacagcctcctaagttgctcatatactgggcatctacccgggattccggggtccctgaccgattcagtggcagcgggtctgggacagatttcactctcaccatcagcagcctgcaggctgaagatgtggcagtttattactgtcagcaacattatagtactcctcgtaccttcggccaagggaccaaggtggaaatcaaa

SEQ ID NO: 2291 - DNA, 369 bp, Homo sapiens
cagctgcagctgcaggagtcgggcccaggactggtgaagccttcggagaccctgtccctcacctgcactgtctctggtggctccatcagcagtactagttactactgggcctggatccgccagcccccagggaaggggctggagtggattgggagtatctattacagtgggagcaccttctacaacccgtccctcaagagtcgagtcaccatatccgtagacacgtccaagaaccagttctccctgaggctgacctctgtgaccgccgcagacacggctgtgtattactgtgcgacattttttaggcagtggctggcggacgaagggtttgactactggggccagggaaccctggtcaccgcctcctca

SEQ ID NO: 2292 - DNA, 321 bp, Homo sapiens
gacatccagatgacccagtctccatcctccctgtctgcatctgtaggagacagcgtcaccatcacttgccgggcaagtcagggcattagaaatgatttaggctggtatcagcagaaaccagggaaagcccctaagcgcctgatctatgctgcatccagtttgcaaaatggggtcccatcaagattcagcggcagtggatctgggacagaattcactctcacaatcagcagcctgcagcctgaagattttgcaacttattactgtctacagtataatagttacccgatcaccttcggccaagggacacgactggagattaaa

SEQ ID NO: 2293 - DNA, 366 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtgggcctactatggttcggggagttatttgggttactggggccagggaaccctggtcaccgtctcctca

SEQ ID NO: 2294 - DNA, 321 bp, Homo sapiens
gaaatagtgatgacgcagtctccagccaccctgtctgtgtctccaggggaaagagccaccctctcctgcagggccagtcagagtgttagcagcaacttagcctggttccagcagaaacctggccaggctcccaggctcctcatctatggtgcatccaccagggtcactgttatcccagccaggttcagtggcagtgggtctgggacagagttcactctcaccatcagcagcctgcagtctgaagattttgcagtttattactgtcagcagtataataactggcctcggacgttcggccaagggaccaaggtggaaatcaaa

SEQ ID NO: 2295 - DNA, 375 bp, Homo sapiens
gaggtgcaactggtggagtctgggggaggcttggtccagcctggggggtccctgagactctcctgtgcagcctctggattcaccgtcagtagcaactacatgagctgggtccgccaggctccagggaaggggctggagtgggtctcagttatttacagcggtggtagcacacactacgcagactccgtgaagggcagattcaccatctccagagacaattccaagaacacgttgtatcttcaaatgaacatcctgagagccgaggacacggctgtgtattactgtgcgagagcgaccccatattgtggtggtgattgctctttcggtgatgcttttgatatctggggccaagggacaatggtcaccgtctcttca

SEQ ID NO: 2296 - DNA, 318 bp, Homo sapiens
gacatccagatgacccagtctccttccaccctgtctgcatctgtaggagacagagtcaccatcacttgccgggccagtcagagtcttagtagctggttggcctggtatcagcagaaaccagggaaagcccctaagctcctgatctataaggcgtctagtttagaaagtggggtcccatcaaggttcagcggcagtggatctgggacagaattcactctcaccatcaacagcctggagccagatgattttgcaacttattactgccaacagtataatagttattggacgttcggccaagggaccaaggtggaaatcaaa

SEQ ID NO: 2297 - DNA, 351 bp, Homo sapiens
caggtgcagctggtgcaatctgggtctgagttgaagaagcctggggcctcagtgaaggtttcctgcaaggcttctggatacaccttcactaggtatgttatgaattgggtgcgacaggcccctggacaagggcttgagtggatgggatggatcaacaccaacactgggaacccaacgtatgcccagggcttcacaggacggtttgtcttctctttggacacctctgtcagcacggcatatctgcagatcagcagcctaaaggctgaggacactgccgtgtattactgtgcgagagtgcagaggctgataccctcatactggggccagggaaccctggtcaccgtctcctca

SEQ ID NO: 2298 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccatcaccttcggccaagggacacgactggagattaaa

SEQ ID NO: 2299 - DNA, 354 bp, Homo sapiens
caggttcaactggtgcagtctggagctgaggtgaagaagcctggggcctcagtgaaggtctcctgcgaggcttctggttacacctttaccagctatggtatcagctgggtgcgacgggcccctggacaagggcttgagtggatgggatggatcagcgcttacaatggtaacacaaattacgcacagaagttccagggcagagtcactatgaccacagacacatccacgagcacagcctacatggagttgaggagcctgagatctgacgacacggccgtgtattactgtgcgagagataactacctcgactggttcgacccctggggccagggaaccccggtcaccgtctcctca

SEQ ID NO: 2300 - DNA, 321 bp, Homo sapiens
gaaattgtgctgactcagtctccagactttcagtctgtgactccacaggagaaagtcaccatcacctgccgggccagtcagagcattggtagtaccttacactggtaccagcagaaaccagatcagtctccaaagctcctcatcaagtatgcttcccagtccatctcaggggtcccctcgaggttcagtggcagtggatctgggacagatttcaccctcaccatcaatagcctggaagctgaagatgctgcaacgtattactgtcatcagagtagtagtttacctcccacttttggccaggggaccaagctggagatcaaa

SEQ ID NO: 2301 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaggggccgattcaccatctccagagacaattccaagaacacgctgtatctgcaaatgaacagcctgagagctgaggacacggctgtgtattactgtgcgagagatcacagtgggagctactggggggcctttgactactggggccagggaaccctggtcaccgtctcctca

SEQ ID NO: 2302 - DNA, 327 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaagtcccgggacagcagtggtaaccatcctgcggtattcggcggagggaccaagctgaccgtccta

SEQ ID NO: 2303 - DNA, 378 bp, Homo sapiens
caggttcacctggtgcagtctggagctgaggtgaagaagcctggggcctccgtgaaggtctcctgcaaggcttctggttacacctttaccaactatggtatcagctgggtgcgacaggcccctggacaagggcttgagtggatgggatggatcagcggtcacaatggtaacacaaattatgcacagaagctccagggcagagtcaccatgaccacagacacatccacgagcacagcctacatggagctgaggagcctgagatctgacgacacggccgtgtattactgtgcgagagatcccgaaccaacggatcctaccatctatggtttggggggttttgactactggggccagggaaccctggtcatcgtctcctca

SEQ ID NO: 2304 - DNA, 321 bp, Homo sapiens
gacatccagatgacccagtctccatcctccctgtctgcatctgtaggagacagagtcaccatcacttgccgggcaagtcagagcataagcagctatttaaattggtatcagcagaaaccagggaaagcccctaagctcctgatctatggtgcatccagtttgaaaagtggggtcccatcaaggttcagtggcagtggatctgggacagatttctctctcaccatcagcagtctgcaacctgaagattttgcaacttactactgtcaacagagttacagtgcccctcgaacgttcggccaagggaccaaggtggaaatcaaa

SEQ ID NO: 2305 - DNA, 363 bp, Homo sapiens
gaggtgcagttagtgcagtctggagcagaggtgaaaaagcccggggagtctctgaagatctcctgtaagcgttctggatacagctttaccacctactggatcggctgggtgcgccagatgcccgggaaaggcctggagtggatggggtccatctatcctggtgactctgataccagatacagcccgtccttccaaggccaggtcaccatttcagccgacaagtccatcagcaccgcctacctgcagtggagcagcctgaaggcctcggacaccgccatgtattactgtgcgagccaggaagtaccgggctactactactacatggacgtctggggcaaagggaccacggtcaccgtctcctca

SEQ ID NO: 2306 - DNA, 324 bp, Homo sapiens
gacatccagatgacccagtctccatcctccctgtctgcatctgtaggagacagagtcaccatcacttgccgggcaagtcagagcattagcagctatttacattggtatcagcagaaaccagggaaagcccctaagctcctgatctatgctgcatccagtttgcaaagtggggtcccatcaaggttcagtggcagtggatctgggacagatttcaccctcaccatcagcagtctgcaacctgaagattttgcaacttactactgtcaacagacttacagtacccacacgtggacgttcggccaagggaccaaggtggaaatcaaa

SEQ ID NO: 2307 - DNA, 369 bp, Homo sapiens
cagatcaccttgaaggagtctggtcctacgctggtgaaacccacacagaccctcacgctgacctgcaccttctctgggttctcactcagcacgagtcgagtgggtgtgggctggatccgtcagcccccaggaaaggccctggagtggcttgcactcatttattggaatgatggtaagctttacagcccatctctgaagagcaggctcaccatcaccaaggacacctccaaaaaccaggtggtccttacactgaccaacatggactctgtggacacagccacttatttctgtgcacgcggccaaactggaactcctttatatgatgcttttgatttctggggccgagggacaatggtcaccgtctcttca

SEQ ID NO: 2308 - DNA, 327 bp, Homo sapiens
tcctatgtgctgactcagccaccctcggtgtcagtggccccaggaaagacggccgggattacctgtgggggagacaactttgaaactaaaagtgtaagctggtaccagcataagccaggccaggcccctgtgctggtcgtctatggtaatgccaaccggccctcagggatccctgagcgattctctgcctccaagtctgggaacacggccaccctgaccatcagcagggtcgaagccggggatgaggccgactattactgtcaggtgtgggatagtcgcagttttcattatgtggttttcggcggagggaccaagttgaccgtccta

SEQ ID NO: 2309 - DNA, 393 bp, Homo sapiens
caggtgcagctgcaggagtcgggcccaggactggtgaagccttcacagaccctgtccctcacctgcactgtctctggtggctccatcagcagtggtagtaactactggacctggatccggcagcccgccgggaagggactggagtggatagggcgtatctataccagtgggagcaccaactacaacccctccctcaagagtcgaggcaccatatcagtagacacgtccaagaaccagttctccctgaagctgagctctgtgaccgccgcagacacggccgtgtattactgtgcgagaggaggtgtaccaggtgctataaaggatattgtagtggtggtagccgcgggtgtctttgatatctggggccaagggacaagggtcaccgtctcttca

SEQ ID NO: 2310 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccaatcaggttcagtggcagtgggtctgggacagagttcactctcaccatcagcagcctgcagtctgaagattttgcagtttattactgtcagcagtataataactggctctggacgttcggccaagggaccaaggtggaaatcaaa

SEQ ID NO: 2311 - DNA, 378 bp, Homo sapiens
gaggtgcagctggtggagtcggggggaggcttggtacagcctggggggtccctgagactctcctgtgcagcctctggattcaccttcagtagctacgacatgcactgggtccgccaagctacaggaaaaggtctggagtgggtctcagctattggtactgctggtgacacatactatccaggctccgtgaagggccgattcaccatctccagagaaaatgccaagaactccttgtatcttcaaatgaacagcctgagagccggggacacggctgtgtattactgtgcaagagttaaatatagcagctcgtctcggagggattactactactactacatggacgtctggggcaaagggaccacggtcaccgtctcctca

SEQ ID NO: 2312 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcattggatctgggacagatttcactctcaccatcagcagtctgcaacctgaagattttgcaacttactactgtcaacagagttacagtgccccggggtacacttttggccaggggaccaagctggagatccaa

SEQ ID NO: 2313 - DNA, 372 bp, Homo sapiens
gaagtgcagctggtggagtctgggggagacttggtacagcctggcaggtccctgagactctcctgtgcagcctctggattcacctttgatgattatgccctgcactgggtccggcaagctccagggaagggcctggagtgggtctcaggtattagttggaatgggggtatcataaactatgcggactctgtgaagggccgattcaccatctccagagacaacgccaagaactccctgtatctgcaaatgatccgtctgagacctgaggacacggccttgtattactgtgcaaaatcaaattgtggtggtgactgctattcccgaataggctttgactactggggccagggaaccctggtcaccgtctcctca

SEQ ID NO: 2314 - DNA, 324 bp, Homo sapiens
tcctatgtgctgactcagccaccctcggtgtcagtggccccaggaaagacggccaggattacctgtgggggcaagaacattggaagtaaaagtgtgcactggtaccagcagaagccaggccaggcccctgtgttggtcgtctatgatgatagcgaccggccctcagggatccctgagcgattctctggctccaactctgggaacacggccaccctgaccatcagcagggtcgaagccggggatgaggccgactattactgtcaggtgtgggatagtagtagtgatcttgtggtattcggcggagggaccaagctgaccgtccta

SEQ ID NO: 2315 - DNA, 372 bp, Homo sapiens
gaggtgcagctgttggagtctgggggaggcttggtacagcctggggggtccctgagactctcctgtgcagcctctggattcacctttaccaactatgccatgagctgggtccgccaggctccagggaaggggctggagtgggtctcaactattagtggtagtggtggtagcacatactacgcagactccgtgaagggccggttcaccatctccagagacaattccaagaacacactatatctgcacatgaacagcctgagagccgaggacacggccgtatattactgtgcgaaaaacgagcggattattatgatagtagtggttaccctctttgactactggggccagggaaccctggtcaccgtctcctca

SEQ ID NO: 2316 - DNA, 330 bp, Homo sapiens
cagtctgtgttgacgcagccgccctcagtgtctgcggccccaggacagagggtcaccatctcctgctctggaagcagctccaacattggcaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccaggctggggacgaggccgattattactgcggaacatgggatagcagcctgagtgctggggttttcggcggagggaccaagttgaccgtccta

SEQ ID NO: 2317 - DNA, 372 bp, Homo sapiens
caggtgcagctggtgcagtctggggctgaggtgaagaagcctgggtcctcggtgaaggtctcctgcaaggcttctggaggcaccttcagcagctatggtatcaattgggtgcgacaggcccctggacaagggcttgagtggatgggagggatcatccctatctttcgtacagcaaactacgcacagaagttccagggcagagtcacgattatcgcggacgaatccacgagcacagcctacatggagctgaggagcctgagatctgaggacacgggcgtgtattactgtgcgagagtggagggggagggggttgacttctaccactacggtatggacgtctgggcccaagggaccacggtcaccgtctcctca

SEQ ID NO: 2318 - DNA, 324 bp, Homo sapiens
tcctctgagctgacacagccaccctcggtgtcagtgtccccaggacagacggccaggatcacctgctctgcagatacattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttatgtgctattcggcggagggaccaagctgaccgtccta

SEQ ID NO: 2319 - DNA, 357 bp, Homo sapiens
caggtgcaactggtggagtctgggggaggcgtggtccagcctgggaggtccctgagactctcctgtgcagcctctggattcaccttcagtatctattctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctctgtattactgtgcgagaagtagtggttattaccctccctatgactactggggccagggaaccctggtcaccgtctcctca

SEQ ID NO: 2320 - DNA, 327 bp, Homo sapiens
tcttctgagctgactcaggaccctgctgtgtctgtggccttgggacagacagtcaggatcacatgccaaggagacagcctcagaagctattatgcaagttggtaccagcagaagccaggacaggcccctgtacttgtcatctatgataaaaacaaccggccctcagggatcccagaccgattctctggctccagctcaggaaacacagcttccttgaccatcactggggctcaggcggaagatgaggctgactattactgtcactcccgagacagcagtggtaaccgtctgggggtattcggcggagggaccaagctgaccgtccta

SEQ ID NO: 2321 - DNA, 354 bp, Homo sapiens
caggtgcagctacagcagtggggcgcaggactgttgaagccttcggagaccctgtccctcacctgcgctgtctatggtgggtccttcagtggttactactggacctggatccgccagcccccagggaaggggctggagtggattggggaaatcaatcctagtggaagcaccaactacaacccgtccctcaagagtcgagtcaccatatcattagacacgtccaacaaccagttctccctgaagctgacctctgtgaccgccgcggacacggctgtgtattactgtgcgagaaggccctggctacgtggtacctttgactactggggccagggaaccctggtcaccgtctcctca

SEQ ID NO: 2322 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtaatgtatgaggataaccaaagaccctctggggtccctgatcggttctctggctccatcgacagctcctccaactctgcctccctcaccatctctggactgaagactgaggacgaggctgactactactgtcagtcttatgatagcagcagtcaaggagtgatattcggcggagggaccaagctgaccgtccta

SEQ ID NO: 2323 - DNA, 372 bp, Homo sapiens
gaggtgcagctgttggaatctgggggacgcttggtacagcctggggggtccctgagactctcctgtgcagcctctggattcacctttagtagctatgccatgaattgggtccgccaggctccagggaaggggctggagtgggtctcagccattagtggaagtggtggtgacacagactacgtcgactccgtgaagggccggttcaccatctccagagacaattccaagaacacgctgtatctgcaaatgaacagcctgagagccgacgacacggccgtatattactgtgcgaaagggcatatgggtcgtttagtgggagctacttgggcgtttgactactggggccagggaaccctggtcaccgtctcctca

SEQ ID NO: 2324 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggccggtcactttcggcggagggaccaaggtggagatcaaa

SEQ ID NO: 2325 - DNA, 378 bp, Homo sapiens
gaggtgcagctggtggagtctgggggaggcctggtcaaacctggggggtccctgagactctcctgtgcagcctctggattccccttcattacttatagcatgaactgggtccgccaggctccagggaaggggctggagtgggtctcatccattagtagaaatagtgattacatatactacgcagactcagtgcggggccgagtcaccatctccagagacaacgccgagaactcactgtatctgcagatgcacagcctgagagccgaagacacggctgtttattactgtgcgagagatgttgtccgttcggggaattattatattccacgtcacggaatggacgtctggggccgagggaccacggtcaccgtctcctca

SEQ ID NO: 2326 - DNA, 330 bp, Homo sapiens
cagtctgtcctgactcagccaccctcagcgtctgggacccccggacagagggtcaccatctcttgttctgggaccagctccaacatcggaagtaatactgtaaactggtaccagcagctccccgaaacggcccccaagctcctcatctatggtactgatcagcggccctcaggggtccctgaccgattctctggctccaagtctggcacctcagcctccctggccatcagtcggctccagtctgaggatgaggctgattattactgtgcaacacgggatgacagcctgagtggtcctgtcttcggaggaggcacccaactgaccgtcctc

SEQ ID NO: 2327 - DNA, 372 bp, Homo sapiens
caggtgcagctggtggagtctgggggaggcgtggtccagcctgggaggtccctgagactctcctgtgcagcctctggattcaccttcagtaactatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagataaattactgtggttcggggagttattattcgacatggacgtctggggcaaagggaccacggtcaccgtctcctca

SEQ ID NO: 2328 - DNA, 321 bp, Homo sapiens
gacatccagatgacccagtctccatcctcactgtctgcatctgtaggagacagagtcaccatcacttgtcgggcgagtcagggcattagcaattatttagcctggtttcagcagaaaccagggaaagcccctaagtccctgatctatgatgcatccagtttgcaaagtggggtcccatcaaagttcagcggcagtggatctgggacagatttcactctcaccatcagcagcctgcagcctgaagattttgcaacttattactgccaacagtataatagttaccctccgtctttcggccctgggaccaaagtggatatcaaa

SEQ ID NO: 2329 - DNA, 360 bp, Homo sapiens
cagctgcagctgcaggagtcgggcccaggactggtgaagccttcggagaccctgtccctcacctgctctgtctctggtggctccatcagcagtagtaattactactggggctggatccgccagcccccagggaaggggctggagtggattgggactgtctattatagtgggagcacctaccacaacccgtccctcaagagtcgagtcatcatatccgtagacacgtccaagaagcagttctccctgaagctgagctctgtgaccgccgcagacacggctgtgtattactgtgcgagacttacgtggctacgggggttgttcgacccctggggccagggaaccctggtcaccgtctcctca

SEQ ID NO: 2330 - DNA, 330 bp, Homo sapiens
aattttatgctgactcagccccactctgtgtcggagtctccggggaagacggtaaccatctcctgcacccacagcagtggcagcattgccagcaactatgtgcagtggtaccagcagcgcccgggcagtgcccccaccactgtgatctttgaggataaccaaagaccctctggggtccctgatcggttctctggctccatcgacagctcctccaactctgcctccctcaccatctctggactgaagactgaggacgaggctgactactactgtcagtcttatgatagcagcaattgggtgttcggcggagggaccaagctgaccgtccta

SEQ ID NO: 2331 - DNA, 378 bp, Homo sapiens
caggttcaactggtgcagtctgaaactgaggtaaagaagcctggggcctcagtgaaggtctcctgcaaggcttctggttacacctttaccagctatggtatcagctgggtgcgacaggcccctggacaagggcttgagtggatgggatggatcaccgcttacaatgataaaaaaaactatgcacagaagttccaggggagagtcaccatgaccacagacacatccacgagcacagcctacatggagctgaggagcctgagatctgacgacacggccgtgtattactgtgcgagagatcggaatattggggcagtggctggtaactactactattacatggatgtctggggcaaagggaccacggtcaccgtctcctca

SEQ ID NO: 2332 - DNA, 327 bp, Homo sapiens
aactttatgctgactcagccccactctgtgtcggagtctccggggaagacggtaaccatctcctgcacccgcagcagtggcagcattgccagaaactatgtgcagtggtaccagcagcgcccgggcagtgcccccaccactgtgatctatgaagataaccacagaccctctggggtccctgatcggttctctggttccatcgacagctcctccaactctgcctccctcaccatctctggactgaagactgaggacgaggctgactactactgtcagtcttatgatagcagcgctcggttcggcggagggaccaagctgaccgtccta

SEQ ID NO: 2333 - DNA, 342 bp, Homo sapiens
gaggtgcagctggtggagtctgggggaggcttggtccagcctggggggtccctgagactctcctgtgcagcctctggattcaccgtcagtagcaactacatgagctgggtccgccaggctccagggaaggggctggagtgggtctcagttatttatagcggcggtagcacattctacgcagactccgtgaagggccgattcaccatctccagagacaattccaagaacacgttgtatctccaaatgaagagcctgagacctgacgacacggctgtgtattattgtgcgagagactacagggattggatctggggccagggaaccctggtcaccgtctcctca

SEQ ID NO: 2334 - DNA, 321 bp, Homo sapiens
gacatccagctgacccagtctccatcctccctgtctgcatctgtaggagacagagtcaccatcacttgccaggcgagtcaggacattagcaagtatttaaattggtatcaacagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccctcggacgttcggccaagggaccaaggtggaaatcaaa

SEQ ID NO: 2335 - DNA, 372 bp, Homo sapiens
caggtgcagctggtggagtctgggggaggcgtggtccagcctgggaggtccctgagactctcctgtgcagcctctgcattcaccttcagaagctatgctatgcactgggtccgccaggctccaggcaaggggctggagtgggtggcagctatatcatatgatggaagcaataaatactacgcagactccgtgaagggccgattcaccatctccagagacaattccaagaacacgctgtatctgcaaatgaacagcctgagagctgaggacacggctgtgtattactgtgcgagagattgggcacctacgtattacaatatgccgtctgcttttgatatctggggccaagggacagtggtcaccgtctcttca

SEQ ID NO: 2336 - DNA, 327 bp, Homo sapiens
tcctatgtgctgactcagccaccctcggtgtcagtggccccaggaaagacggccaggattacctgtgggggaaacaacattggaagtaaaagtgtgtactggtatcagcagaagccaggccaggcccctgtgctggtcgtcaatgatgatagcgaccggccctcagggatccctgagcgattctctggctccaactctgggaacacggccaccctgaccatcagcagggtcgaagccggggatgaggccgactattactgtcaggtgtgggatagtagtagtgatcatccgggggtgttcggcggagggaccaagctgaccgtcctt

SEQ ID NO: 2337 - DNA, 360 bp, Homo sapiens
gaggtgcagctggtggagtctgggggaggcttggtacagcctggggggtccctgagactctcctgtgcagcctctggattcaccttcagtacctacgacatgcactgggtacgccaaactacaggaaaaggtctggagtgggtctcagctattggtactgctggtgacacatactatccagactccgtgaagggccgattcaccatctccagagaaaatgccaagaactccttgtatcttcaaatgaacagcctgagagccggggacacggctgtgtattactgtgcaagagggggccaatggctacgagtctggtacttcgatctctggggccgtggcaccctggtcactgtctcctca

SEQ ID NO: 2338 - DNA, 324 bp, Homo sapiens
gacatccagatgacccagtctccatcctccctgtctgcatctgtaggagacagagtcaccatcacttgccgggcaagtcagagcattagcaggtatttaaattggtatcagcagaaaccagggaaagcccctaagctcctgatctatggtgcatccagtttgcaaagtggggtcccatcaaggttcagtggcagtggatctgggacagatttcactctcaccatcagcagtctgcaacctgaagattttgcaacttactactgtcaacagagttacagtaaccctgagctcactttcggcggagggaccaaggtggagatcaaa

SEQ ID NO: 2339 - DNA, 363 bp, Homo sapiens
gacgtgcagctggtgcagtctggagcagaggtgaaaaagcccggggagtctttgaagatctcctgtaagggttctggatataggtttaccagctactggatcgcctgggtgcgccagatgcccgggaaaggcctggagtggatggggatcatttatcctggtgactctgataccagatatagcccgtccttccaaggccaggtcaccatctcagccgacaagtccatcagtaccgcctacctgcagtggagcagcctgaaggcctcggacaccgccatgtattactgtgcgagtcaagcagcagctggctacttctactacatggacgtctggggcaaagggaccacggtcaccgtctcctca

SEQ ID NO: 2340 - DNA, 321 bp, Homo sapiens
gacatccagatgacccagtctccatcctccctgtctgcatctgtaggagacagagtcaccatcacttgccgggcaagtcagagcattagcatgtatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccttgtggacgttcggccaagggaccaaggtggaaatcaaa

SEQ ID NO: 2341 - DNA, 348 bp, Homo sapiens
gaggtgcagctgttggagtctgggggaggcttggtacagcctggggggtccctgagactctcctgtgcagcctctggattcacctttaacagctatgccatgagctgggtccgccaggctccagggaaggggctggagtgggtctcagctattagtggtagtggtggtagtacatactacgcagactccgtgaagggccggttctccatctccagagacaatgccaagaacacgctgtttctgcaaatgaacagcctgagagccgaggacacggccgtatattactgtgcgaggagtggcggaaactttgactactggggccagggaaccctggtcaccgtctcctta

SEQ ID NO: 2342 - DNA, 324 bp, Homo sapiens
tcctatgagctgacacagccaccctcggtgtcagtgtccccaggacagacggccaggatcacctgctctggagatgtattggcaaagcgatatgtttattggtaccagcagaagccaggccaggcccctgtgctggtgatatatagagacagtgagaggccctcagggatccctgagcgattctctggctccagctcagggacaacagtcacgttgaccatcagtggagtccaggcagtagacgaggctgactattactgtcaatcagcagacagcagtggtactctttatgtcttcggaactgggaccaaggtcaccgtccta

SEQ ID NO: 2343 - DNA, 372 bp, Homo sapiens
gaggtgcagctggcggagtctgggggaggcttggtaaagcctggggggtcccttagactctcctgtgcagcctctggattcactttcagtaacgcctggatgaactgggtccgccaggctccagggaaggggctggagtgggttggccgtattaaaagcaaaactgatggtggggcaacagactacgctgcacccgtgaaaggcagattcaccatctcaagagatgattcaaaaaacacgctgtatctgcaaatgaacagcctgaaaaccgaggacacagccgtgtattattgtaccacagataactggagctactacggttactggtacttcgatttctggggccgtggcaccctggtcactgtctcctca

SEQ ID NO: 2344 - DNA, 324 bp, Homo sapiens
gacatccagatgacccagtctccatcctccctgtctgcatctgtaggagacagagtcaccatcacttgccgggcaagtcagagcattagcagctatttaaattggtatcaacagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtccccccctgtacacttttggccaggggaccaagctggagatcaaa

SEQ ID NO: 2345 - DNA, 366 bp, Homo sapiens
cagctgcagctgcaggagtcgggcccaggactggtgaagccttcggagaccctgtccctcacctgcactgtctctggtggctccatcagcagtagtagttattactggagttggatccgccagcccccagggaaggggctggagtggattgggagtatctattatagtgggagcacctactacaacccgtccctcaagagtcgagtcaccatatccgtagacaggtccaagaaccagttctccctgaagctgaggtctgtgaccgccgcagacacggctgtgtattactgtgcgagtccctggtattgtagtggtggcaggtgctttgactactggggccagggaaccctggtcaccgtctcctca

SEQ ID NO: 2346 - DNA, 324 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatgtatgatgcatccaacagggccactggcatcccagccaggttcagtggcagtgggtctgggacagacttcactctcaccatcagcagcctagagcctgaagattttgcagtttattactgtcagcagcgtagcaactggcctccctggacgttcggccaagggaccaaggtggaaatcaaa

SEQ ID NO: 2347 - DNA, 369 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcatcggctatgcggactctgtgaagggccgattcaccatctccagagacaccgccaagaactccctgtatctgcaaatgaacagtctgagagctgaggacacggccttgtattactgtgcaaaagtgggtcttaccagctgctattttttttgtgcttttgatatctggggccaagggacaatggtcaccgtctcttca

SEQ ID NO: 2348 - DNA, 330 bp, Homo sapiens
cagtctgccctgactcagcctgcctccgtgtctgggtctcctggacagtcgatcaccatctcctgcactggaaccagtagtgatgttgggagttataaccttgtctcctggtaccaacaacacccaggcaaagcccccaaactcatgatctatgagggcagtaagcggccctcaggggtttctaatcgcttctctggctccaagtctggcaacacggcctccctgacaatctctgggctccaggctgaggacgaggctgattattactgctgctcatatgcagttactaacactttggtattcggcggagggaccaagctgaccgtccta

SEQ ID NO: 2349 - DNA, 363 bp, Homo sapiens
gaggtgcaactggtggagtctgggggaggcttggtacagcctggagggtccctgagactctcctgtgcagcctctggattcaggttcagtagttatgaaatgaactgggtccgccaggctccagggaaggggctggagtgggtttcatacattagtagaactggtagttccatattttatgcagactctgtgaagggccgattcaccatctccagagacgacgccaagaactcactgtatctacaaatgaacagcctgagagccgaggacacggctgtttattactgtgcgagagcgatgtattactatggttcggggaccctagactactggggccagggaaccctggtcaccgtctcctca

SEQ ID NO: 2350 - DNA, 321 bp, Homo sapiens
gacatccagatgacccagtctccatcctccctgtctgcatctgtaggagacagagtcaccatcacttgccgggcgagtcagagcattagcaactttttaaattggtatcagcagaaaccagggaaagcccctaagctcctgatctatgatgtatccagtttgcaaagtggggtcccatcaaggttcagtggcagtggatctgggacagatttcgctctcaccatcagcagtctgcaacctgaagattttgcaacttactactgtcaacagagttacacttcccctccgtctttcggccctgggaccgaagtggatagcaaa

SEQ ID NO: 2351 - DNA, 381 bp, Homo sapiens
caggtgcagctggtggagtctgggggaggcgtggtccagcctgggaggtccctgagactctcctgtgcagcctctggattcactatcagcagttacggcatgcactgggtccgccaggctccaggcaaggggctggagtgggtggcagttatatcatatgatggaagtgataaatactatgcagactccgtgaagggccgattcaccatatctagagacaattccgagaacacgctgtatctgcaaatgaacagcctgagagctgaggacacggctgtgtattactgtgcgaaagcctaccggggggacatgattacgtttgggggagttatcgcgccccttgagtattggggccagggaaccctggtcaccgtctcttca

SEQ ID NO: 2352 - DNA, 333 bp, Homo sapiens
cagtctgtgctgacgcagccgccctcagtgtctggggccccagggcagagggtcaccatctcctgcactgggagcagctccaacatcggggcaggttatgatgtatactggtaccagcagcttccaggaacagcccccaaactcctcatctatggtaacaccaatcggccctcaggggtccctgaccgattctctggctccaagtctggcacctcagcctccctggccatcactgggctccaggctgaggatgaggctgattattactgccagtcctatgacagcagcctgagtgtcttggtcttcggaactgggaccaaggtcaccgtccta

SEQ ID NO: 2353 - DNA, 390 bp, Homo sapiens
caggtgcagctgcaggagtcgggcccaggactggtgaagccttcacagaccctgtccctcacctgcactgtctctggtggctccatcagcagtggtatttactactggagctggatccggcagcccgccgggaagggactggagtggattgggcgtatctattccagtgggagcaccaactacaacccctccctcaagagtcgagtctccatgtcagtagacacgtccaagaaccagttctccctgaagctgaggtctgtgtccgccgcagacacggccgtgtattactgtgcgagagattgcccgcattacaatttttggagtggtcattataaggactactactacatggacgtctggggcaaagggaccacggtcaccgtctcctca

SEQ ID NO: 2354 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgtacttttggccaggggaccaagctggagatcaaa

SEQ ID NO: 2355 - DNA, 363 bp, Homo sapiens
caggtccagctggtacagtctggggctgaggtgaagaagcctggggcctcagtgaaggtctcctgcaagatttccggatacaccctcactgaagtatccattcactgggtgcgacaggctccaggaaaagggcttgagtggatgggaggttttgatcctgaagctggtgaaacaatctacgcacggaagttccagggcagagtcaccatgaccgaggacacatctacagacacagcctatatggacctgagcggcctgagatctgaggacacggccgtgtattactgtgcaacttcccctgctatttatcgacagacctggttcgacccctggggccagggaaccctggtcaccgtctcctca

SEQ ID NO: 2356 - DNA, 333 bp, Homo sapiens
cagtctgtgttgacgcagccgccctcagtgtctgcggccccaggacagaacgtcaccatctcctgctctggaagcagctccaacattggcaataattatgtatcctggtaccagcagctcccaggaacagcccccaaactcctcatttatgacaataataagcgaccctcagggattcctgaccgattctctggctccaagtctggcacgtcagccaccctgggcatctccggactccagactggggacgaggccgattattactgcggaacatgggatactagcctgagtgttggaggggtattcggcggagggaccaagctgaccgtccta

SEQ ID NO: 2357 - DNA, 372 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaagcatcatccctatccttggtatagcaaactacgcacagaagtttccgggccgagtcacgattaccgcggacaaatccacgagcacagcctacatggagctgagcagtctgagatctgaggacacggccgtgtatttctgtgcgaaccaacgtggatatagtggctacggggcagttagctggttcgacccctggggccagggaaccctggtcaccgtctcctca

SEQ ID NO: 2358 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagtaatcggccctcaggggtccctgaccgattctctggctccaagtctggcacctcagcctccctggccatcactggactccaggctgaggatgaggctgattattactgccagtcctatgacagcagcctgagtggtgtggtattcggcggagggaccaagctgaccgtccta

SEQ ID NO: 2359 - DNA, 378 bp, Homo sapiens
caggtgcagctggtgcaatctgagtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctccttggagacctctgtcagcacggcatatctgcagatcaacagcctaaaggctgaggacactgccgtgtattactgtgcgagagattttgacgacaactggaacggtgactactcctactattacatggacgtctggggcaaagggaccacggtcaccgtctcctca

SEQ ID NO: 2360 - DNA, 336 bp, Homo sapiens
gatattgtgatgacccagactccactctctctgtccgtcacccctggacagtcggcctccatctcctgcaagtctagtcagagcctcctgcacagtgatggaaagacctatttgtcttggtacctgcagaagccaggccagtctccacagctcctgatctatgaattttacaacaggttctctggagtgccagataggttcagtggcagcgggtcagggacagatttcacactgaaaatcagccgggtggaggctgaggatgttggggtttattactgcatgcaaagtatagagcttccgtacacgtttggccaggggaccaagctggagatcaaa

SEQ ID NO: 2361 - DNA, 369 bp, Homo sapiens
caggtacagttacaacaattgggcgcaggactgttgaagccttccgagaccctgtccctcacctgcactgtctctggtgcgtccttcgctgggtactactggagatggatccgccagtccccgggaaaggggctggagtggcttggggaaatcaatcagagtggagtcaccgactacaacccgtccctcaagagtcgagtcaccatttcagtagacacgtccaagacccaattgtccctgagactgacttctgtgaccgccgcggacacggctgtctattattgtgcgagaaggggctatttctatggttcggagataccctactactttgactactggggccagggatccctcgtcaccgtctcctca

SEQ ID NO: 2362 - DNA, 324 bp, Homo sapiens
gaaattgtgttgacgcagtctccaggcaccctgtctttgtctccaggggaaagagccaccctctcctgcagggccagtgagagtgttagcggcaattccttagcctggtaccagcagaaacctggccaggctcccagtctcctcatctatggcgcctccagtagggccactggcatcccagacaggttcagtggccgtgggtctgggacagacttcagtctcaccatcagcaggctggagcctgaagattttgcagtgtattactgtcagcagtatggtagctcacctcgaacgttcggccaagggaccaaggtggaaatcaag

SEQ ID NO: 2363 - DNA, 369 bp, Homo sapiens
caggtgcagctggtggagtctgggggaggcgtggtccagcctgggaggtccctgagactctcctgtgcagcctctggattcaccttcagtagttatggcattcactgggtccgccaggctccaggcaaggggctggagtgggtggcacttatatcatatgatggaagtgataaattctatgcagactccgtgaagggccgcttcaccatctccagagacaattccaagaacacgctgtatctcgtaatgaacagcctgagagttgacgacacggctgtgtattactgtgcgaaaggagtgggcttgtatagcagccccttgtactactttgactactggggccagggaaccctggtcaccgtctcctca

SEQ ID NO: 2364 - DNA, 318 bp, Homo sapiens
gacatccagatgacccagtctccatcctccctgtctgcatctgtaggagacagagtcaccatcacttgccaggcgagtcaggacattaacaactatttaaattggtatcagcagaaaccagggaaagcccctgaactcctgatctacgatgcgtccaatttggaagcaggggtcccatcaaggttcagtggaagtggatctgggacagattttactttcaccatcagcagcctgcagcctgaagatattgcaacatattactgtcaacagtttgataatctcccctctttcggccctgggaccaaagtggatatcaaa

SEQ ID NO: 2365 - DNA, 384 bp, Homo sapiens
gaggtgcagctggtgcagtctggagcagaggtgaaaaagcccggggagtctctgaagatctcctgtaagggttctgcatacagctttaccagctactggatcgcctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtacgagaggccgaccggtctcaggaatatgggtcggggagactgctccgtactactttgactactggggccagggaaccctggtcaccgtctcctca

SEQ ID NO: 2366 - DNA, 321 bp, Homo sapiens
gaaattgtgttgacgcagtctccaggcaccctgtctttgtctccaggggaaagacccaccctctcctgcagggccagtcagagtgttagcagcaactacttagcctggtaccagcagaaacctggccaggctcccaggctcctcatctacggtgcatccagcagggcctctggcatcccagacaggttcagtggcagtgggtctgggacagacttcactctcaccatcagcagactggagcctgaagattttgcagtgtattactgtcagcagtatggtagctcaccgacgttcggccaagggaccagggtggaaatcaaa

SEQ ID NO: 2367 - DNA, 366 bp, Homo sapiens
caggtgcagctggtggagtctgggggaggcgtggtccagcctgggaggtccctgagactctcctgtgcagcctctggattcaccttcagtagctatgccatgcactgggtccgccaggctccaggcaaggggctggagtgggtggcagttatatcatatgatggaagtgataaatactatgcagactccgtgaagggccgattcaccatctccagagacaattccaagaacacgctgtatctgcaaatgaacagcctgagaggtgaggacacggctgtctattactgtgcgaaaggcgactggtatagcagcagctggtacccccttgaatactggggccagggaatcctggtcaccgtctcctca

SEQ ID NO: 2368 - DNA, 321 bp, Homo sapiens
gagatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctgaccatcagcagcctgcagtctgaagattttgcagtttattactgtcagcactataatgactggccgtacacttttggccaggggaccaagctggagatcaaa

SEQ ID NO: 2369 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggaatgggtggcagtcatatcgtatgatggaagcaataaatacttcgcagactccgtgaggggccgattcaccatctccagagacaattccaagaacacgctgtatctgcaaatgaacagcctgagagctgaggacacggctgtgtattactgtgcgagacccgtagtaccagctgttatggggagctactacggtatggacgtctggggccaagggaccacggtcaccgtctcctca

SEQ ID NO: 2370 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcacctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtgtggttttcggcggagggaccaagctgaccgtccta

SEQ ID NO: 2371 - DNA, 351 bp, Homo sapiens
gaggtgcagctggtggagtctggaggaggcttgatccagcctggggggtccctgagactctcctgtgcagcctctgagtttatcgtcagtagcaactacatgagttgggtccgccaggctccagggaaggggctggagtgggtctcagttatttatcccggtggtagcacattctacgcagactccgtgaagggccgattcaccatctccagagacagttccaagaacacactatatcttcaaatgaacagcctgagagccgaggacacggccgtctattactgtgcgagagactacggtgacttctactttgactactggggccagggaaccctggtcaccgtctcctca

SEQ ID NO: 2372 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccaccagaaacctggccaggctcccaggctcctcatctatggtgcatccaccagggccactggtatcccagccaggttcagtggcagtgggtctgggacagagttcactctcaccatcagcagcctgcagtctgaagattttgcagtttattcctgtcagcagtataataactggcctcggacgttcggccaagggaccaaggtggaaatcaaa

SEQ ID NO: 2373 - DNA, 384 bp, Homo sapiens
caggtgcagctgcaggagtcgggcccaggactggtgaagccttcacagaccctgtccctcacctgcagtgtctctggtgcctccatcagcagtggtagttactactggagttggatccggcagcccgccgggaagggactggagtgggtggggcgtctctatacccgtgggagcaccaactacaacccctccctcaagagtcgagtcacgatgtcagtagacacgtccaagaaccagttctccctgaagctgagctctgtgaccgccgcagacacggccgtctattactgcgcggtcagtacatattactatggttcggggagtctctactactacaagtacatggacgtctggggcaaagggaccacggtcaccgtctcctca

SEQ ID NO: 2374 - DNA, 330 bp, Homo sapiens
cagtctgtgctgactcagccaccctcagcgtctgggacccccgggcagagggtcaccatctcttgttctggaagcagctccaacatcggaagtaatattgtaaactggtaccagcacctcccaggaacggcccccaaactcctcatctatagtaataatcagcggccctcaggggtccctgaccgattctctggctccaagtctggcacctcagcctccctggccatcagtggactccagtctgaggatgaggctgattattactgtgcagcatgggatgacagcctgaatggttatgtcttcggaactgggaccaaggtcaccgtccta

SEQ ID NO: 2375 - DNA, 363 bp, Homo sapiens
caggtccagctggtgcaatctggggctgaggtgaagaagcctgggtcctcggtgaaggtctcctgcaaggcttctggaggcaccttcggcagctatactatcaactgggtgcgacaggcccctggacaagggcttgagtggatgggaaggatcttccctattctaagtatagcaacctacgcacagaagttcctgggcagagtcgcgattaccgcggacaaatccacgagcacagcctacatggagctgagcagcctgagatctgaggacacggccgtgtattactgtgcgaggggggtggtagcttctactcccaactggtttgacccctggggccagggaaccctggtcaccgtctcctca

SEQ ID NO: 2376 - DNA, 318 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatgatgcatccaccagggccactggtatcccagccaggttcagtggcagtgggtctgggacagagttcactctcaccatcagcagcctgcagtctgaagattttgcagtttattactgtcagcagtataataactggctcactttcggcggagggaccaaggtggagatcaaa

SEQ ID NO: 2377 - DNA, 366 bp, Homo sapiens
gaggtgcagctggtggagtctgggggaggcttggtgcagcctggggggtccctgagactctcctgtgcagcctctggattcaccttcagtagctacgacatgcactgggtccgccaagcaacaggaaaaggtctggagtgggtctcagttattggtactgctggtgacacatactatccagactccgtgaagggccgattcaccatctccagagaaaatgccaagaactccttgtatcttcaaatgaacagcctgagagccggggacacggctgtgtattactgtgcaagggccatctatgatagtagtggttattattttgcttttgatatgtggggccaagggacaatggtcaccgtctcttca

SEQ ID NO: 2378 - DNA, 324 bp, Homo sapiens
gacatccagatgacccagtctccatcctccctgtctgcatctgtaggagacagagtcaccatcacttgccgggcaagtcagagcattagcagctatttaaattggtatcaacagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccttgcgctcactttcggcggagggaccaaggtagagatcaaa

SEQ ID NO: 2379 - DNA, 363 bp, Homo sapiens
gaggtgcaactggtggagtctgggggaggcttggtacagcctggagggtccctgagactctcctgtgcagcctctggattcaggttcagtaattatgaaatgaactgggtccgccaggctccagggaaggggctggagtgggtttcatacattagtagtactggtggttccatattttacgcagactctgtgaagggccgattcaccatctccagaggcgacgccaagaactcagtatatctgcaaatgaacagcctgagagccgaggacacggctgtttattactgtgcgagagcgatgtattactatggttcggggaccctagactactggggccagggaaccctggtcaccgtctcctca

SEQ ID NO: 2380 - DNA, 321 bp, Homo sapiens
gacatccagatgacccagtctccatcctccctgtctgcatctgtaggagacagagtcaccatcacttgccgggcgagtcagagcattagtaggtttttaaattggtatcagcagaaaccagggacagcccctaagctcctgatctatgatgtatccagtttgcaaagtggggtcccaacaaggttcagtggcagtggatctgggacagatttcacgctcaccatcagcagtctgcaacctgaagattttgcaacttactactgtcaacagagttacactacccctccggctttcggccctgggaccagagtggatatcaaa

SEQ ID NO: 2381 - DNA, 369 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaagcaataaatactactcagactccgtgaagggccgattcaccatctccagagacaattccaagaacacgctgtatctgcaaatgaacagcctgagagctgaggacacggctgtgtattactgtgcgagagcacataccagtggctggccacttggggactactttgactactggggccagggaaccctggtcaccgtctcctca

SEQ ID NO: 2382 - DNA, 336 bp, Homo sapiens
gatattgtgatgactcagtctccactctccctgcccgtcacccctggagagccggcctccatctcctgcaagtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacgaaccccgctcactttcggcggagggaccaaggtggagatcaaa

SEQ ID NO: 2383 - DNA, 369 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatttgatggaagtaataaatactatgtagactccgtgaagggccgattcaccatctccagagacaattccaagaacacgcagtatttgcaaatgaacagcctgagagctgaggacacggctgtgtattattgtgcgaaagagggctttgggtatggttcggcaaagtactactttgactactggggccagggaaccctggtcaccgtctcctca

SEQ ID NO: 2384 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatgataatctccccctcactttcggcggagggaccaaggtggagatcaaa

SEQ ID NO: 2385 - DNA, 351 bp, Homo sapiens
gaggtgcagctggtggagtctggaggaggcttgatccagcctggggggtccctgagactctcctgtgcagcctctgggttcaccgtcagtagcaactacatgagctgggtccgccaggctccagggaaggggctggagtgggtctcacttatttatagcggtggtagcacattctacgcagactccgtgaagggccgattcaccatctccagagacaattccaagaacacgctgtatcttcaaatgaacagcctcagagccgaggacagggccgtgtattactgtgcgagagacctccagtcctacggtatggacgtctggggccaagggaccacggtcaccgtctcctca

SEQ ID NO: 2386 - DNA, 327 bp, Homo sapiens
gacatccagttgacccagtctccatccttcctgtctgcatctgtaggagacagagtcaccatcacttgccgggccagtcagggcattagcaattatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttacccttccatgtacacttttggccaggggaccaagctggagatcaaa

SEQ ID NO: 2387 - DNA, 387 bp, Homo sapiens
caggtgcagctggtggagtctgggggaggcgtggtccagcctgggaggtccctgagactctcctgtgcagcctctggattcaccttcagtacctctggcatgcactgggtccgccaggctccaggcaaggggctggagtgggtggcaattatatcatatgatggaagtaataaacattatgcagtctccgtgaagggccgattcaccatctccagagacaattctaagaacacgctgtatctgcaaatgaacagcctgagagctgaggacacggctgtgtattactgtgcgaaaggagggcccaacaaagtagtactatcgttcggggatttattggactacggtttggacgtctggggccaaggggccacggtcaccgtctcctca

SEQ ID NO: 2388 - DNA, 336 bp, Homo sapiens
gatattgtcatgacccagactccactctctctgtccgtcacccctggacagccggcctccatctcctgcaagtctagtcagagcctcctgcatagtgatggaaagacctatttgtattggtacctgcagaagccaggccagtctccacaactcctgatctatgaagtttccacccggttctctggagtgccagatacgttcagtggcagcgggtcagggacagatttcacactgaaaatcagccgggtggaggctgaggatgttggggtttattactgcatgcaaagtatacagcttccgtacacttttggccagggaaccaagctggagatcaaa

SEQ ID NO: 2389 - DNA, 360 bp, Homo sapiens
caggtgcagctgcaggagtcgggcccaggactggtgaagccttcacagaccctgtccctcacctgcactgtctctggtggctccatcagcagtggtaattactactggagttggatccgccagcccccagggaagggcctggagtggattgggcacatctattacagtgggaccacccactacaacccgtccctcaagagtcgagttagcatatcagtagacacgtccaaggaccagatctccctgaagctaacctctgtgactgccgcagacacggccgtgtattactgtgccaggctattgtggctacggggcgcttttgatatctggggccaagggacaatggtcaccgcctcttca

SEQ ID NO: 2390 - DNA, 333 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttttgatagcaacaatccggtggtattcggcggagggaccaagctgaccgtccta

SEQ ID NO: 2391 - DNA, 378 bp, Homo sapiens
caggtgcagctggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactggagagccaacgtatgcccagggcttcacaggacggtttgtcttctccttggacacctctgtcagcacggcatatctgcagatcagcagcctaaaggctgaggacactgccgtatattactgtgcgagagatcatgatcgcaatttccagctcgaatataattattattacatggacgtctggggcaaagggaccacggtcaccgtctcctca

SEQ ID NO: 2392 - DNA, 336 bp, Homo sapiens
gatattgtgatgacccaaactccactctctctgtccgtcacccctggacagccggcctccatctcctgcaagtctggtgagagcctcctgcatggtgatggaaagacctatttgtattggtacctgcagaagccaggccagtctccacagctcctgatctatgaagttttcaaccggttctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaa

SEQ ID NO: 2393 - DNA, 378 bp, Homo sapiens
caggtgcagctggtggagtctgggggaggcgtggtccagcctgggaggtccctgagactcgcctgtgcagcctctggattcaccttcagtagttatggcatgcactgggtccgccaggctccaggcaaggggctggagtgggtggcagttatatcatatgatggaaataataaatactatgcagactctctgaagggccgattcaccatctccagagacgattccaagaacacgctgtatctgcagatgaacagcctgagagctgaggacacggctgtgtattactgtgcgaaagatcggacagctgtgtttctattcttcggcctaggagatgcttttgatatctggggccaagggacaatggtcaccgtctcttca

SEQ ID NO: 2394 - DNA, 324 bp, Homo sapiens
tcctatgtgctgactcagccaccctcggtgtcagtggccccaggaaagacggccaggattacctgtgggggaaacaacattggaagtaaaagtgtgcactggtaccagcagaagccaggccaggcccctgtggttgtcgtctatgatgatagcgaccggccctcagggctccctgagcgattctctggctccaactctgggaacacggccaccctgaccatcagcagggtcgaagccggggatgaggccgactattactgtcaggtgtgggatagtagtagtgatcattgggtgttcggcggagggaccaagctgaccgtccta

SEQ ID NO: 2395 - DNA, 351 bp, Homo sapiens
caggtgcagctggtgcaatctgggtctgagttgaagaagcctggggcctcagtgaaggtttcctgcaaggcttctggatacaccttcagtagctattctatgaattgggtgcgacaggcccctggacaagggcttgagtggatgggatggatcaacaccaacactggaaacccaacgtttgcccagggcttcacaggacggtttgtcttctccttggacacctctgtcagcacggcatatctgcagatcagcagcctaaaggctgaggacactgccgtgtattactgtgcgagagagctgggtaccagcgttgacctctggggccagggaaccctggtcaccgtctcctca

SEQ ID NO: 2396 - DNA, 324 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggttaccatccggtattcggcggagggaccaagctgaccgtccta

SEQ ID NO: 2397 - DNA, 381 bp, Homo sapiens
caggtgcagctggtggagtctgggggaggcgtggtccagcctgggaggtccctgagactctcctgtgtagcctctgaattcaccttcagtaaccatggcatgcactgggtccgccaggctccaggcaaggggctggagtgggtggcagttatatcatatgatggaagtgataaatactatgcacactccgtgaagggccgattcaccatctccagagacagttccaagaacacgctgtatctgcaaatgaacagcctgagagctgaggacacggctgtgtattactgtgcgaaagcctaccggggggatatgattacgtttgggggagttatcgcgccccttgactactggggccagggaaccctggtcaccgtctcctca

SEQ ID NO: 2398 - DNA, 333 bp, Homo sapiens
cagtctgtgctgacgcagccgccctcagtgtctggggccccagggcagagggtcaccatctcctgcactgggagcagctccaacatcggggcaggttatgatgtatactggtaccagcagtttccaggatcagcccccaaactcctcatctatggttacaacaatcggccctcaggggtccctgaccgattctctggctccaagtctggcacctcagcctccctggccatcactgggctccaggctgaggatgaggctgattattactgccagtcctatgacagcagcctgagtgtcttggtcttcggaactgggaccaaggtcaccgtccta

SEQ ID NO: 2399 - DNA, 390 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtaccctaggctatgcggactctgtgaagggccgattcaccttctccagagacaacgccaagaactccgtgtatctgcaaatgaacagtctgagagctgaggacacggccttgtattactgtgcaaaagatggcccggtcgcggataccagcagacgggcgcacacttactacttctacggtatggacgtctggggccaagggaccacggtcaccgtctcctca

SEQ ID NO: 2400 - DNA, 324 bp, Homo sapiens
tcgtatgtgctgactcagccaccctcggtgtcagtggccccaggaaagacggccaggattacctgtgggggaaacaacattggaagtaaaagtgtgaactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatactagtactgatctcgtggtattcggcggagggaccaagctgaccgtccta

SEQ ID NO: 2401 - DNA, 366 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaaggccttgagtggttgggaggttttgatcctgaagatgctgaaacaatctacgcacagaagttccagggcagagtcaccatgaccgaggacacatctacagacacagcctacatggagctgagcagcctgagatctgaggacacggccgtatattactgtgcaacagttccagccgcgataactggacctacttttgtctggtactggggccagggaaccctggtcaccgtctcctca

SEQ ID NO: 2402 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcaactcccaggaacggcccccaaactcctcatctatactcataatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtccta

SEQ ID NO: 2403 - DNA, 384 bp, Homo sapiens
caggtccagctggtgcaatctggggctgaggtgaagaagcctgggtcctcggtgaaggtctcctgcaaggcttctggaggcaccttcagcagtaatactatcagctgggtgcgacaggcccctggacaagggcttgagtggatgggaaggatcatccctctccttggcacagtaaactacgcacagaagttccagggcagagtcacgattaccgcggacaaatccacgaccacagcctacatggagctgagcagcctgagatctgaggacacggccgtgtattactgtgcgagagatgctgggggtattacgatttttggagtggaacactactactactacatggacgtctggggcaaagggaccacggtcaccgtcacgtca

SEQ ID NO: 2404 - DNA, 330 bp, Homo sapiens
gaaattgtgttgacgcagtctccaggcaccctgtctttgtctccaggggaaagagccaccctctcctgcagggccagtcagagtgttagcagcagccacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctccgatgtacacttttggccaggggaccaagctggagatcaaa

SEQ ID NO: 2405 - DNA, 375 bp, Homo sapiens
gaggtgcagctgttggagtctgggggaggcttggtacagcctggggggtccctgagactctcctgtgcagcctctggattcacctttagcagctatgccatgaactgggtccgccaggctccagggaaggggctggagtgggtctcaactattagtggtagtggtggtagcacatactacgcagactccgtgaagggccggttcaccatctccagagacaattccaagaacacgctgtatctgcaaatgaacagcctgagagccgacgacacggccgtatattactgtgcgaaagggccgatggcatatattctagtggtggtagctgcttactttgactactggggccagggaaccctggtcaccgtctcctca

SEQ ID NO: 2406 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccaacaacttccaggaatagtccccaaactcctcatttatgacaataataagcgactctcagggattcctgaccgattctctggctccaagtctggcacgtcagccaccctgggcatcaccggactccagactggggacgaggccgattattactgcggaacatgggatagcagcctgagtgctgtggtattcggcggagggaccaagctgaccgtccta

SEQ ID NO: 2407 - DNA, 363 bp, Homo sapiens
caggtgcagctggtgcagtctggggctgaggtgaagaagcctgggtcctcggtgaaggtctcctgcaaggcttctggaggcaccttcagcgactatgtaatctactgggtgcgacaggcccctggacaagggcttgagtggatgggagggaccacccctatctttggaacagctaactacgcacagaagttccagggcagagtcacgattaccgcggacgaatccacgagcacagcctacatggagctgagcagcctgagatctgaggacacggccgtgtattactgtgcgagatcgtgcggtgactgctattccgccgactttgactcctggggccagggaacccaggtcaccgtctcctca

SEQ ID NO: 2408 - DNA, 324 bp, Homo sapiens
gaaattgtgttgacacagtctccagccaccctgtctttgtctccaggggaaagagccaccctctcctgcagggccagtcagagtattagcagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaggattttgcagtttattactgtcagcgccgtagcaactggcctcctttcactttcggccctgggaccaaagtggatatcaaa

SEQ ID NO: 2409 - DNA, 363 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttaatcctgaagatgttgaaacaatctacgcacagaagttccagggcagagtcaccatgaccgaggacacatctacagacacagcctacatggaactgagcagcctgagatctgaggacacggccgtgtattactgtgcaacagcattttcgatttttggagtggttatgtttgactactggggccagggaaccctggtcaccgtctccaca

SEQ ID NO: 2410 - DNA, 327 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatgccctattcggcggagggaccaagctgaccgtccta

SEQ ID NO: 2411 - DNA, 372 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtggtggtggtagcacatactacgcagactccgtgaagggccggttcaccatctccagagacaattccaagaacacgctgtatctgcaaatgaacagcctgagagccgaggacacggccgtatattactgtgcgaaagacgaaatgggggtgatagtagtggttattacgttatttgactactggggccagggaaccctggtcaccgtctcctca

SEQ ID NO: 2412 - DNA, 330 bp, Homo sapiens
cagtctgtggtgacgcagccgccctcagtgtctgcggccccaggacagaaggtcaccatctcctgctctggaagcagctccaacattgggaaaaattatgtatcctggtaccagcagctcccaggaacagtccccaagctcctcatttatgacaataataagcgaccctcagggattcctgatcgattctctggctccaagtctggcacgtcagccaccctgggcatcaccggactccagactggggacgaggccgattattactgcggaacatgggatagcagcctgagtgtctttgtcttcggaactgggaccaaggtcaccgtccta

SEQ ID NO: 2413 - DNA, 369 bp, Homo sapiens
gaagtgcagctggtggagtctgggggaggcttggtacagcctggcaggtccctgagactctcctgtgcagcctctggactcacctttgaggattatgccatgcactgggtccggcaagttccagggaagggcctggagtgggtctcaggtattagttggaatagtggtaccataggctatgcggactctgtgaagggccgattcatcatctccagagacaacgccaagaactccctgtatctgcaaatgagaagtctgagagctgaggacacggccttgtattactgtgcaaaagatgtggggttcggggagttattatactatgcttttgatatctggggccaagggacaatggtcaccgtctcttca

SEQ ID NO: 2414 - DNA, 330 bp, Homo sapiens
cagtctgccctgactcagcctgcctccgtgtccgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtccta

SEQ ID NO: 2415 - DNA, 381 bp, Homo sapiens
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcagttatatcatatgatggaagtaataaatactatgcagactccgtgaagggccgattcaccatctccagagacaattcccagaacacgctgtatctgcaaatgaacagcctgagagctgaggacacggctgtgtattactgtgcgaaacaaggggagccgtattgtagtgctggtaactgctactcgggctactttgactactggggccagggaaccctggtcaccgtctcctca

SEQ ID NO: 2416 - DNA, 324 bp, Homo sapiens
tcctatgagctgacacagccaccctcggtgtcagtgtccccaggacagacggccaggatcacctgctctgcagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggcgtccaggcagaagacgaggctgactattactgtcaatcaggagacagcagtggtacccccgtggtattcggcggagggaccaagctgaccgtccta

SEQ ID NO: 2417 - DNA, 369 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtggggggcacttatatcatttgatggagaaaataagttctatgcagactccgtgaagggccgattcaccatctccagagacaattccaagaacacgctgtatctgcaaatgaacagcctgagagctgaggacacggctgtttattactgtgcgaaagagggatttgggtatgcttcggcaaagtactactttgactactggggccagggaaccctggtcaccgtctcctca

SEQ ID NO: 2418 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagattttgcaacatatttctgtcaagagtatgatgatctccccctcactttcggcggagggaccaaggtggagatcaaa

SEQ ID NO: 2419 - DNA, 354 bp, Homo sapiens
caggtgcagctacagcagtgggacgcaggactgttgaagccttcggagaccctgtccctcacctgcgctgtctatggtgggtccttcagtggttactactggacctggatccgccagcccccagggaaggggctggagtggattggggaaatctatcctagtggaagcaccaactacaacccgtccctcaagagtcgagtcaccatatcattagacacgtccaacaaccagttctccctgaaggtgacctctgtgaccgccgcggacacggctgtgtattactgtgcgagaaggccctggctacgtggtacctttgactactggggccagggaaccctggtcaccgtctcctca

SEQ ID NO: 2420 - DNA, 321 bp, Homo sapiens
gaagttgtgttgacacagtctccagccaccctgtctttgtctccaggggaaagagcctccctctcctgcagggccagtcagagtgttcgcagctccttagcctggtaccaacaaaaacctggccaacctccccggctcctcatctatggtgcatccaacagggccactggcatcccagccaggttcagtggcagtgggtctgggacagacttcactctcaccgtcagcagcctagagcctgaagattttgtagtttattactgtcagcagcgtaccaactggccaggcaccttcggccaggggacacgactggagattaaa

SEQ ID NO: 2421 - DNA, 369 bp, Homo sapiens
caggtgcagctggtgcagtctggggctgaggtgaagaagcctggggcctcagtgaaggtctcctgcaaggcttctggatacaccttcagcagttatgaaatcaattgggtgcgacaggccactggacaagggcttgagtggatgggacggatgactcttaacagtggtaacacaggctatgcacagaacttccagggcagagtcactatgaccagggacacctccataagcacagcctacatggagctgagcggcctgagatctgaggacacggccgtgtattactgtgcgagaatgcgcagtggctggcccacacatggccgcccggatgactactggggccaaggaaccctggtcaccgtctcctca

SEQ ID NO: 2422 - DNA, 330 bp, Homo sapiens
cagtctgtgctgactcagccaccctcagcgtctgggacccccgggcagagggtcaccatctcttgttctggaagtaactccaatatcggaagttatactgtaaactggtaccagcaactcccaggaacggcccccaaactgctcatctatggtaataatcagcggccctcaggggtccctgaccgattctctggctccaagtctgggacctcagcctccctggccatcagtggcctccagtctgaggatgaggctgattattactgtttggcatgggatgacagccggaatggcctggtattcggcggagggaccaagctgaccgtccta

SEQ ID NO: 2423 - DNA, 342 bp, Homo sapiens
gaggtgcggctggtggagtctgggggaggcttggtccagcctggggggtccctgagactctcctgtgcagcctctggattcaccgtcagtagcaactacatgagctgggtccgccaggctccagggaaggggctggagtgggtctcacttatttatagcggtggtagcacattttatgcagactccgtgaagggccgattcaccatctccagagacaattccaagaacacgctgtatcttcaaatgaacagcctgagagctgaggacacggctctgtattactgtgcgagagatacgagggatgaggcgtggggccagggaaccctggtcaccgtctcctca

SEQ ID NO: 2424 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaaggtcctgatctacgatgcatccaatttggaaacaggggtcccatcaaggttcagtggaagcggatctgggacagattttactttcaccatcagcagcctgcagcctgaagatattgcaacatattactgtcaacagtatgataatctccctcgcacttttggccaggggaccaagctggagatcaaa

SEQ ID NO: 2425 - DNA, 381 bp, Homo sapiens
caggttcagctggtgcagtctggagctgaggtgaagaagcctggggcctcagtgaaggtctcctgcaaggcttctggttacacatttaccagttatggtatcagctgggtgcgacaggcccctggacaagggcttgagtggatgggatggatcagcggttacaatggtcacacaagttatgcacagaagctccagggcagagtcgctatgaccacagacacatccacgagcacagcctacatggagctgaggagcctgagatctgacgacacggccgtgtattactgtgccagagatcaggggtcggattactatgatagtagtgattattatgcggctttagactactggggccagggaaccctggtcaccgtctcctca

SEQ ID NO: 2426 - DNA, 321 bp, Homo sapiens
tcctatgagctgacacagccatcctcagtgtcagtgtctccgggacagacagccaggatcacctgctcaggagatgtactggcaaaaaaatatgctcggtggttccagcagaagccaggccaggcccctatactggtgatttataaagacagtgagcggccctcagggatccctgagcgattctccggctccagctcagggaccacagtcaccttgaccatcagcggggcccaggttgaggatgaggctgactattattgttactctgcggctgacaacaatccaagggttttcggcggagggaccaagctgaccgtccta

SEQ ID NO: 2427 - DNA, 366 bp, Homo sapiens
caggtgcagctgcaggagtcgggcccaggactggtgaagccttcggagaccctgtccctcacctgcactgtctctggtggctccatcactaattcttactggacttggatccggcagcccccagggaagggactggagtggattggatatatctattacagtgggagcaccaactacaacccctccctcaagagtcgagtcactatattagtagacacgtccaagaagcagttctccctgaggctgagctctgtgaccgctgcggacacggccatttattactgtgcgagaggtgaacaccagctgctatactgggacaactggttcgacccctggggccagggaaccctggtcaccgtctcctca

SEQ ID NO: 2428 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtccta

SEQ ID NO: 2429 - DNA, 390 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccgtggagtggcttgcactcattggttgggatgatgataaatactacagcacttctctgaggaccaggctcgccatctccaaggacacctccaaaaaccaggtggtccttacaatgaccaacgtggaccctgtggacacagccacgtattactgtgcacggacccgccccactggacatagtggctacgatttcggttttccggaggcgttcttcgacctttggggccagggaaccctggtcaccgtctcctca

SEQ ID NO: 2430 - DNA, 306 bp, Homo sapiens
gacatccagatgacccagtctccatcctccctgtctgcatctgtaggagacagagtcaccatcacttgccgggcaagtcagagcattagcagctatttaaattgctatcagcagaaatcagggaaagcccctaagctcctgatctatgctgcgtccagtttgcaaagtggggtcccatcaaggttcagtggcagtggatctgggacagatttcactctcaccatcagcagtctgcaacctgaagattttgcaacttacaactgtctacacatcactttcggccctgggaccaaagtggatatcaaa

SEQ ID NO: 2431 - DNA, 366 bp, Homo sapiens
caggtccagctggtacagtctggggctgaggtgaagaagcctggggcctcagtgaaggtctcctgcaaggtttccggatacaccctcactgaattatccatgcactgggtgcgacaggctcttggaaaagggcttgagtggatgggaggttttgatcctgaagatgttgaaacaatctacgcacagaagttccagggcagagtcaccatgaccgaggacacatctacagacacagcctacatggagctgagcagcctgagatctgaagacacggccgtctattactgtgcaacagttccagccgcgataactggaactacttttgtctggtactggggccagggaaccctggtcaccgtctcctca

SEQ ID NO: 2432 - DNA, 330 bp, Homo sapiens
cagtctgtgctgactcagccaccctcagcgtctgggacccccgggcagagggtcaccatctcttgttctggaagcagctccaacatcggaagtagtactgtaaactggtaccagcagctcccaggaacggcccccaaactcctcatctatagtaataatcagcggcccgcaggggtccctgaccgattctctggctccaagtctggcacctcagcctccctggccatcagtgggctccagtctgaggatggggctgattattactgtgcagcatgggatgacagcctgaatggttgggtgttcggcggagggaccaagctgaccgtccta

SEQ ID NO: 2433 - DNA, 369 bp, Homo sapiens
caggtgcagctggtggagtctgggggaggcgtggtccagcctgggaggtccctgagactctcctgtgcagcctctggattcaccttcagtaactatgacatgcactgggtccgccaggctccaggcaaggggctggagtgggtggcagttatttcatatgatggaagtaataaatactatgcagactccgtgaggggccgattcaccatctccagagacaattccaagagcacgctgtatttgcaaatcaacagcctgagagctgaggacacggctgtcttttactgtgcgaaaagtggatacagctatgcttataggcattactactttgactactggggccagggaaccctggtcaccgtctcctca

SEQ ID NO: 2434 - DNA, 327 bp, Homo sapiens
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctgtgatgatagcgaccggccctcagggatccctgagcgattctctggctccaactctgggaacacggccaccctgaccatcagcagggtcgaagacggggatgaggccgactattactgtcaggtgtgggatagtagtagtgatcatcccgtggtattcggcggagggaccaagctgaccgtccta

SEQ ID NO: 2435 - DNA, 372 bp, Homo sapiens
gaggtgcagctggtggagtctgggggaggcttggtacagcctggggggtccctgagactctcctgtgcagcctctggattcaccttcagtagctatgacatgcactgggtccgccaagctacagggaaaggtctggagtgggtctcagctattggtactgctggagacacatactatccagactccgtgaagggccgattcaccatctccagagaaaatgccaagaactccttgtttcttcaaatgaacagcctgagaggcggggacacggctgtgtattactgtgcaagaggggatagcatcagctggtacggggccttctactattacatggacgtctggggcaaagggaccacggtcaccgtctcctca

SEQ ID NO: 2436 - DNA, 324 bp, Homo sapiens
gacatccagatgacccagtctccatcctccctgtctgcatctgtaggagacagagtcaccatcacttgccgggcaagtcagagcattagcaggtatctaaattggtatcagcagagaccagggaaagcccctaagctcctgatctatgctgcatccagtttgcaaagtggggtcccatcaagtttcagtggcagtggatctgggacagatttcactctcaccatcagcagtctgcaacctgaagattttgcaacttactactgtcaacagagttacagttcccctccgtggacgttcggccaagggaccaaggtggaaatcaaa

SEQ ID NO: 2437 - DNA, 351 bp, Homo sapiens
gaggtgcagctggtggagtctggaggaggcttgatccagccgggggggtccctgagactctcctgtgcagcctctggggtcatcgtcagtagcaactacatgagctgggtccgccagggtacagggaaggggctggagtgggtctcacttatttatagcggtggtagcacatactacgcagactccgtgaagggccgattcaccatctccagagacaattccaagaacacgctgtatcttcaaatgaacaacctgagagccgaggacacggccgtgtattactgtgcgagagacttgcaggtctacggtatggacgtctggggccaagggaccacggtcaccgtctcctca

SEQ ID NO: 2438 - DNA, 324 bp, Homo sapiens
tcctatgtgctgactcagccaccctcggtgtcagtggccccaggaaagacggccaggattacctgtgggggaaacaacattggaagtgaaagtgtgcactggtaccagcagaagccaggccaggcccctgtgctggtcgtctatgatgatagcgaccggccctcagggatccctgagcgattctctggctccgactctgggaacacggccaccctgaccatcagcagggtcgaagccggggatgaggccgactattactgtcaggtgtgggatagtagtagtgatcattgggtgttcggcggagggacgaagctgaccgtccta

SEQ ID NO: 2439 - DNA, 381 bp, Homo sapiens
caggtgcagctggtggagtctgggggaggcgtggtccagcctgggaggtccctgagactctcctgtgcagcctctggattcaccttaagtagtcatggcatgcactgggtccgccaggctccaggcaaggggctggagtgggtggcagtgatatcatatgatggaaatgataaatactatgcagactccgtgaagggccgattcaccatctccagagacaattccaagaacacgctgtatctgcaaatgaacagcctgagagctgaggacacggctgtctattactgtgcgaaagcctaccggggggatatgatcacgtttgggggagttatcgcgccccttgactactggggccagggaaccctggtcaccgtctcctca

SEQ ID NO: 2440 - DNA, 333 bp, Homo sapiens
cagtctgtgctgacgcagccgccctcagtgtctggggccccagggcagagtgtcaccatctcctgcactgggagcagctccaacatcggggcaggttatgatgtatactggtaccagcagcttccaggaacagcccccaaactcctcatctatggtaacaacaatcggccctcaggggtccctgaccgattctctggctccaagtctggcacctcagcctccctggccatcactgggctccaggctgaggatgaggctaattattactgccagtcctatgacagcagcctgactgtcttggtcttcggaactgggaccaaggtcaccgtccta

SEQ ID NO: 2441 - DNA, 381 bp, Homo sapiens
caggtgcagctggtgcagtctggggctgaggtgaagaagcctggggcctcagtgaaggtctcctgcaaggcttctggatacaccttcgccagttatgatatcaactgggtgcgacaggccactggacaagggcctgagtggatgggatggatgatccctaacattggtaacacaggctatgcacagaagttccagggcagagtcaccatgaccaggaacacctccataagcacagcctacatggagctgagcagcctgacatctgaggacacggccgtgtattactgtgcgagagtttctaggctatttaatgacttcggtctaagacatgaggcacccgttgacttctggggccagggaacccgggtcaccgtctcctca

SEQ ID NO: 2442 - DNA, 330 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggttacagcagtcggccctcaggggtccctgaccgattctctggctccaagtctggcacctcagcctccctggccatcactgggctccaggctgaggatgaggctgattattactgccagtcctatgacagcagcctgagtgttttattcggcggagggaccaagctgaccgtccta

SEQ ID NO: 2443 - DNA, 363 bp, Homo sapiens
gaggtgcaactggtggagtctgggggaggcttggtacagcctggagggtccctgagactctcctgtgcagcctctggattcagcttcagtagttatgaaatgaactgggtccgccaggctccagggaaggggctggagtgggtttcatacattagtagtactggtagttccatattttacgcagactctgtgaagggccgattcaccatctccagagacgacgccaagaactcagtgtatctgcaaatgaacagcctgagagccgaggacacggctgtttattactgtgcgagagcgatgtattactatggttcggggaccctagactactggggccagggaaccctggtcaccgtctcctca

SEQ ID NO: 2444 - DNA, 321 bp, Homo sapiens
gacatccagatgacccagtctccatcctccctgtctgcatctgtaggagacagagtcaccatcacttgccgggcgagtcagagcattagcagctatttaaattggtatcagcagaaaccagggaaagcccctaagctcctgatctatgatgtatccagtttgcaaagtggggtcccatcaaggttcagtggcagtggatctgggacagatttcactctcaccatcagcagtctgcaacctgaagattttgcaacttactactgtcaacagagttacactacccctccggctttcggccctgggaccaaagtggatatcaaa

SEQ ID NO: 2445 - DNA, 357 bp, Homo sapiens
gaggtgcagctggtggagtctgggggaggcctggtcaagcctggggggtccctgagactctcctgtgccgcctctggattcacctttagtagctatagcatgaactgggtccgccaggctccagggaaggggctggagtgggtctcaaccattagtgatagtagtagttacatatactacgcagactcagtgaagggccgattcaccatctccagagacaacgccaagaactcactgtatctgcaactgaacagcctgagagccgaggacacggctgtctattactgtgcgagggagggacagtgggagcgactctttgtttcctggggccagggaaccctggtcaccgtctcctca

SEQ ID NO: 2446 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttatttggggacgttcggccaagggaccaaggtggaaatcaaa

SEQ ID NO: 2447 - DNA, 372 bp, Homo sapiens
gaggtgcagctggtggagtctgggggaggcttggtacagcctggagggtccctgagactctcctgtgcagcctctggatttaccttcagtagttatgaaatgaactgggtccgccaggctccagggaaggggctggagtgggtttcatatattagtagtagtggtagtagtatatactacgcagactccgtgaagggccgattcaccatctccagagacaacgccaagaactcactgtatctgcaaatgaacagcctgagagccgaggacacggctgtttactactgtgcgagagagcccctaggacctggttactacaactactactacatggacgtctggggcaaagggaccacggtcaccgtctcctca

SEQ ID NO: 2448 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagccccccaactcatgatttatgaggtcagtaagcggccctcaggggtttctaatcgcttctctggctccaagtctggcaacacggcctccctgacaatctctgggctccaggctgaggacgaggctgattattattgctgctcatatgcaggtagtagcactttcccctatgtcttcggaactgggaccaaggtcaccgtccta

SEQ ID NO: 2449 - DNA, 345 bp, Homo sapiens
gaggtgcagctggtggagtctgggggaggcttggtccagcctggggggtccctgagactctcctgtgcagcctctggattcacctttagtaactattggatgagttgggtccgccaggctccagggaaggggctggagtgggtggccaacataaaagaagatggaagtgagaaatactatgtggactctgtgaagggccgattcaccatctccagagacaacgccaagaagtcagtgtatctgcaaatgaacagcctgagagtcgaggacacggctgtgtattactgtgcgagaggtcacgggttcgacccctggggccagggaaccctggtcaccgtctcctca

SEQ ID NO: 2450 - DNA, 324 bp, Homo sapiens
tcttctgagctgactcaggaccctgctgtgtctgtggccttgggacagacagtcaggatcacatgccaaggagacagcctcagaagctattctgcaagctggttccagcagaagccaggacaggcccctatacttgtcatctatcctaaaaacaaccggccctcagggatcccagaccgattctctggctccagctcaggaaacagagcttccttgaccatcactggggctcaggcggaagatgaggctgactattactgtaactcccgggacagcagtggtaaccattatgtcttcggaactgggaccaaggtcaccgtccta

SEQ ID NO: 2451 - DNA, 363 bp, Homo sapiens
caggtgcagctggtgcagtctggggctgaggtgaagaagcctgggtcctcggtgaaggtctcctgcaaggcgtctggaggcaccttcagcagctatgctatcagctgggtgcgacaggcccctggacaagggcttgagtggatgggagggatcatccctatttttggtacagcaaagtacgcacagaagttccagggcagagtcacgattaccgcggacgaatccacgagcacagtctacatggagttgagcagcctgagatctgaggacgcggccgtgtattactgtgcgagaaccagtggttacgatgcctacgtcgtgtctgactactggggccagggaaccctggtcaccgtctcctca

SEQ ID NO: 2452 - DNA, 327 bp, Homo sapiens
gaaattgtgttgacacagtctccagccaccctgtctttgtctccaggggaaagagccaccctctcctgcagggccagtcagagtgttagcagcttcttagcctggttccaacagaaacctggccaggctcccaggctcctcatctatgatgcatccaacagggccactggcatcccagccaggttcactggcagtgggtctgggacagacttcactctcaccatcagcagcctagagcctgaagattttgcagtttattactgtcagcagcgtagcaactggcctcccctactcactttcggcggagggaccaaggtggagatcaaa

SEQ ID NO: 2453 - DNA, 363 bp, Homo sapiens
caggtgcagctggtggagtctgggggaggcgtggtccagcctgggaggtccctgagactctcctgtgcagcctctggattcatcttcagtagctatgctatacactgggtccgccaggctccaggcaaggggctggagtgggtggcagttatctcatatgatggaagcagtgaatactacgcagactccgtgaagggccgattcaccatctccagagacaattccaagaacacgctgtatctgcaaatgaaccgcctgagacctgaggacacggctgtgtattactgtgcgagggcgtacagtgggacctactacagtccatttgactactggggccagggaaccctggtcaccgtctcctca

SEQ ID NO: 2454 - DNA, 324 bp, Homo sapiens
gaaatagtgatgacgcagtctccagccaccctgtctgtgtctccaggggaaagagccaccctctcctgcagggccagtcagagtgttagtagcaacttagcctggtaccagcagaaacctggccagggtcccaggctcctcatctatggtgcatccaccagggccactggtatcccagccaggttcagcggcagtgggtctgggacagagttcactctcaccatcagcagcctgcagtctgaagattttgcagtttattactgtcagcagtataataagtggcctccgaacacttttggccaggggaccaagctggagatcaaa

SEQ ID NO: 2455 - DNA, 363 bp, Homo sapiens
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtggtagcacatactatgcagactctgtggagggccgattcaccatctccagagacaacagcaaaaactccctttatctgcaaatgaacagtctgagaactgaggacaccgccttgtattactgtgcaaaagatttggacccagttgtaatgttcccggttagttcctggggccagggaacccgggtcaccgtctcctca

SEQ ID NO: 2456 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtattatagttattccgcggcgttcggccaagggaccaaggtggaaatcaaa

SEQ ID NO: 2457 - DNA, 369 bp, Homo sapiens
caagtgcagctggtgcagtctggggctgaggtgaagaagcctgggtcctcggtgaaggtctcctgcaaggcttctggaggcaccttcagcagctatgttgacatctgggtgcgacaggcccctggacaagggcttgagtggatgggagggatcatccctatctttaacacaacaaactacgcacagaagttccagggcagagtcacgattaccgcggacgaatccacgagcacagcctacatggagctgagcagcctgagatctgaggacacggccgtgtactactgtgcgagactacagattactatggttcggggagtcattaccgatgactactggggccagggaaccctggtcaccgtctcctca

SEQ ID NO: 2458 - DNA, 327 bp, Homo sapiens
gaaattgtgttgacacagtctccagccaccctgtctttgtctccaggggaaagagccaccctctcctgcagggccagtcagagtgttagcagctacttagcctggtaccaacaaaaacctggccaggctcccaggctcctcatctatgatgcatccaacagggccactggcatccctgccaggttcagtggcagtgggtctgggacagacttcactctcaccatcagcggccttgagcctgaagattttgcagtttattactgtcaccatcgtagcaactggcctccgcggctcactttcggcggagggaccaaggtggagatcaaa

SEQ ID NO: 2459 - DNA, 366 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaatctacgcacagaagttccagggcagagtcacgattaccgcgggcgaatccacgagcacaggctacatggagctgagcagcctgagatctgaggacacggccgtgtattactgtgcgagaacgatgggctatgacagtagtggttattacgaggactactggggccagggaaccctggtcaccgtctcctca

SEQ ID NO: 2460 - DNA, 327 bp, Homo sapiens
gaaattgtgttgacacagtctccagccaccctgtctttgtctccaggggaaagagccaccctctcctgcagggccagtcagagtattagcaacttcttagcctggtaccaacagaaacctggccaggctcccaggctcctcatctatgatgcatccaacagggccactggcatcccagccaggttcagtggcagtgggtctgggacagacttcactctcaccatcagcagcctagagcctggagattttgcagtttattactgtcagcagcgtagcaactggcctccgaggctcaccttcggccaagggacacgactggagattaaa

SEQ ID NO: 2461 - DNA, 390 bp, Homo sapiens; identical to SEQ ID NO: 2429

SEQ ID NO: 2462 - DNA, 321 bp, Homo sapiens
gaaatagtgatgacgcagtctccagccaccctgtctgtgtctccaggggaaagagccaccctcttctgcagggccagtcagagtgttagcagcaacttagcctggtaccagcagaaatctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcccttgacgttcggccaagggaccaaggtggaaatcaaa

SEQ ID NO: 2463 - DNA, 363 bp, Homo sapiens
caggtgcaactggtggaatctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaatcaataaatactacgcagactccgtgaagggccgattcaccatctccagagacaattccaagaacacgctgtatctgcaaatgaacagcctgagagctgaggacacggctgtgtattactgtgcgagaggtaagagtgggagctactactacggtatggacgtctggggccaagggaccacggtcaccgtctcctca

SEQ ID NO: 2464 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttacctgtggaccttcggccaagggaccaaggtggaaatcaaa

SEQ ID NO: 2465 - DNA, 378 bp, Homo sapiens
gaagtgcagctggtggagtctgggggaggcttcgtacagcctggcaggtccctgagactctcctgtgcagcctctggattcacctttgatgatcatgtcatgcactgggtccggcaagctccagggaagggcctggagtgggtctcaggtattagttggaatagtggtaacatagactatgcggactctgtgaagggccgattcaccatctccagagacaacgccaagaactccctgtatctgcaaatgaacagtctgagagctgaggacacggccttgtattactgtgcgaaagattcccaatattgtagtagtaccaactgctattttagctggttcgccccctggggccagggaaccctggtcaccgtctcctca

SEQ ID NO: 2466 - DNA, 321 bp, Homo sapiens
gacatccagatgacccagtctccatcctccctgtctacatctgtaggagacagagtcaccatcacttgccgggcaagtcagagcattgacagctatttaaattggtatcaacagacaccggggaaagcccctaagctcctgatctatgctgcatccaatttacaaagtggggtcccatcaaggttcagtggcagtggctctgggacagatttcactctcaccatcagcaatctgcaacctgaagattttgcaacttactactgtcaacagagttacagtccccctcggacttttggccaggggaccaagctggagatcaaa

SEQ ID NO: 2467 - DNA, 384 bp, Homo sapiens
caggtgcagctgcaggagtcgggcccaggactggtgaagccttcggagaccctgtccctcacctgcactgtctctggttgctccatcagtagttactactggagctggatccggcagcccccagggaagggactggaatggattggatatatctcttatagtgggagcaccaactacaacccctccctcaagagtcgagtcaccatatcagtagacacgtccaagaaccagttctccctgaagctgagctctgtgaccgctgcggacacggccgtgtattactgtgcgagaatatcggattactatggttcggggacctcttattttggctactactacggtatggacgtctggggccaagggaccacggtcaccgtctcctca

SEQ ID NO: 2468 - DNA, 333 bp, Homo sapiens
cagtctgtgctgacgcagccgccctcagtgtctggggccccagggcagagggtcaccatctcctgcactgggagcagctccaacttcggggcaggttatgatgtacactggtaccagcagcttccaggaacagcccccaaactcctcatctatggtaacaccaatcggccctcaggggtccctgaccgattctctggctccaagtctggcacctcagcctccctggccatcactgggctccaggctgaggatgaggcagattattactgccagtcctatgacagcagcctgagtggaggggtattcggcggagggaccaagctgaccgtccta

SEQ ID NO: 2469 - DNA, 378 bp, Homo sapiens
caggtgcagctggtgcagtctggggctgaggtgaagaagtctggggcctcagtgaaggtctcctgcaaggcttctgaatacaccttcaccagttatgatatcaactgggtgcgacaggccactggacaagggcttgagtggatgggatggatgagccctaacagtggcaacacaggctatgcacagaagttccagggcagagtcaccatgaccaggaacacctccataagcacagcctacatggaactgagcagcctgaaatctgaggacacggccgtgtattactgtgcgagaggcggtagaaatgggatagtagtggttcttacttcggatgcttttgatatctggggccaagggacactggtcaccgtctcttca

SEQ ID NO: 2470 - DNA, 318 bp, Homo sapiens
tcctatgtactgactcagccaccctcaatgtcagtggccccaggaaagacggccaggattacctgtgggggaaacaacattggaagtaacagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatagtactactgtggtattcggcggagggaccaagctgaccgtccta

SEQ ID NO: 2471 - DNA, 360 bp, Homo sapiens
caggtgcagctggtgcagtctggggctgaggtgaagaagcctgggtcctcggtgaaggtctcctgcaaggcttctggaggcaccttcagcagctatgctctcagctgggtgcgacaggcccctggacaagggcttgagtggatgggagggatcatccctatctttggtacaacaaactacgcacagaagttccagggcagagtcacgattaccgcggacgaatccacgagcacagcctacatggtactgagcagcctgagatctgaggacacggccgtgtattactgtgcgaggcatagtggctacgatcgggggcacagagactactggggccagggaaccctggtcaccgtctcctca

SEQ ID NO: 2472 - DNA, 327 bp, Homo sapiens
gaaattgtgttaacacagtctccagccaccgtgtctttgtctccaggggaaagagccaccctctcctgcagggccagtcagagtgttagcagcttcttagactggtaccaacagaaacctggccaggctcccaggctcctcatctatgatgcatccaacagggccactggcatcccagccaggttcagtggccgtgggtctgggacagacttcactctcaccatcagcagcctagagcctgaagattttgcagtttattactgtcaccaccgtaacaactggcctccgaggctcactttcggcggagggaccaaggtggagatcaaa

SEQ ID NO: 2473 - DNA, 363 bp, Homo sapiens
caggtgcagctggtggagtctgggggaggcgtggtccagcctgggaggtccctgagactctcctgtgcagcctctggattcaccttcagtatctatgctatgcactgggtccgccaggctccaggcaaggggctggagtgggtggcagttatatcctatgatggaatcaataaatactacgcagactccgtgaagggccgattcaccatctccagagacaattccaagaacacgctgtatctgcaaatgaacagcctgagagctgaggacacggctgtgtattactgtgcgagagatatgagtgggagctactacggggcctttgactcctggggccagggagccctggtcaccgtctcctca

SEQ ID NO: 2474 - DNA, 315 bp, Homo sapiens
gaaattgtgctgactcagtctccagactttcagtctgtgactccaaaggagaaagtcaccatcacctgccgggccagtcagagcattggtagtaccttacactggtaccagcagaaaccgggtcagtctccaaggctcctcatcaagtatgcttcccagtccatctcaggggtcccctcgaggttcagtggcagtggatctgggacagatttcaccctcaccatcaatagcctggaagctgaagatgctgcaacgtattactgtcatcagagtagttcattcactttcggccctgggaccaaagtggatatcaaa

SEQ ID NO: 2475 - DNA, 378 bp, Homo sapiens
caggtgcagctggtggagtctgggggaggcgtggtccagcctgggaggtccctgagactctcctgtgcagcctctggattcaccttcagtagccatgttatgcactgggtccgccaggctccaggcaaggggctggagtgggtggcagttatatcagatgatggaagcaataaatactacgcagactccgtgaagggccgattcaccatcttcagagacaaatccaagaacacgctgtatctgcaaatgaacagcctgagaactgaggacacggctgtgtattactgtgcgagagattacgttgtaatggtggtacctgctactttttactacggtatggacgtctggggccaagggaccacagtcaccgtctcctca

SEQ ID NO: 2476 - DNA, 345 bp, Homo sapiens
caggctgtgctgactcagccgtcttccctctctgcatctcctggagcatcagccagtctcacctgcaccttacgcagtggcatcaatgttggtacctacaggatatactggtaccagcagaagccagggagtcctccccagtatctcctgaggtacaaatcagactcagataagcagcagggctctggagtccccagccgattctctggatccaaagatgcttcggccaatgcagggattttactcatctctgggctccagtctgaggatgaggctgactattactgtatgatttggcacagcagcgtcgtggtattcggcggagggaccaagctgaccgtccta

SEQ ID NO: 2477 - DNA, 363 bp, Homo sapiens
gaggtgcagctgttggagtctgggggaggcttggtgcagcctggggggtccctgagactctcctgtgcagcctctggaatcacctttatcagctatgccatgatatgggtccgccgggctccagggaaggggctggagtgggtctcaggtatcagtggcagtggtggtagcacagactacgcagactccgtgaagggccggttcaccatctccagagacaattccaagaacacactatatctgcaaatgaacagcctgagagccgaggacacggccgtatattactgtgcgaaagccccgactatacttcggggagtttactttgactactggggccagggaatcctggtcaccgtctcctca

SEQ ID NO: 2478 - DNA, 330 bp, Homo sapiens
cagtctgccctgactcagcctgcctccgtgtctgggtctcctggacagtcgatcaccatctcctgcactggaaccagcagtgacgttggtggtaataattatgtctcctggtaccaacaacacccaggcaaagcccccaaactcatgatttatgatgtcattaatcggccctcaggggtttctaatcgcttctctggctccaagtctggcaacacggcctccctgaccatctctgggctccaggctgaggacgaggctgattattactgcagttcatatacaagcagcagcactctagtattcggcggagggaccagcctgaccgtccta

SEQ ID NO: 2479 - DNA, 372 bp, Homo sapiens
gaggtgcagctggtggagtctgggggaggcttggtccagcctggggggtccctgagagtctcctgtgcagcctctggattcacctttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagttttcgacgatttttggagtgattatatgggatcatttgactactggggccagggaaccctggtcaccgtctcctca

SEQ ID NO: 2480 - DNA, 318 bp, Homo sapiens
tcctatgagctgactcagccaccctcagtgtccgtgtccccaggacagacagccagcatcacctgctctggagataaattgggggatgaatatgcttcctggtatcagcggaagccaggccagtcccctgtgatggtcatctatcaagataccaagcggccctcagccatccctgagcgattctctggctccaactctgggaacacagccactctgaccatcagcgggacccagcctatggatgaggctgactattactgtcagacgtgggacaccagcaccgtggtattcggcggagggaccaagctgaccgtccta

SEQ ID NO: 2481 - DNA, 363 bp, Homo sapiens
caggtgcagctggtggagtctgggggaggcgtggtccagcctgggaggtccctgagactctcctgtgcagcctctggattcaccttcagtagctatgctacgcactgggtccgccaggctccaggcaaggggctggagtgggtggcagttatatcatatgatggaaccaataaatactacgcagactccgtgaagggccgattcaccatctccagagacaattccaagaacacgctgtatctgcaaatgaacagtctgagagctgaggacacggctgtgtattactgtgcgagagcttggatgggatcctactactacggtatggatgtctggggccaagggaccacggtcaccgtctccaca

SEQ ID NO: 2482 - DNA, 321 bp, Homo sapiens
gacatccagatgacccagtctccatcttccgtgtctgcatctgtaggagacagagtcaccatcgcttgtcgggcgagtcagggtattagcagctggttagcctggtatcaccagaaaccagggaaagcccctgagctcctgatctatgctgcatccagtttgcaaagtggggtcccatcaaggttcagcggcagtggatctgggacagatttcactctcaccatcaccagcctgcagcctgaagattttgcaacttactattgtcaacaggctaacagtttccctcccactttcggcggagggaccaaggtggagatcaat

SEQ ID NO: 2483 - DNA, 387 bp, Homo sapiens
gaggtgcagctggtggagtctgggggaggtgtggtacggcctggggggtccctgagactctcctgtgcagcctctggattcacctttgatgattatggcatgagctgggtccgccaagctccagggaaggggctggagtgggtctctggtattacttggaatggtggcagtacaggttatgcagactctgtgaagggccgattcaccatctccagagacaacgccaagaactccctgtatctgcaaatgagcagtctgagcgccgaggacacggccttgtatcactgtgcactgattctgtctccagtcccccgttacagtggctacgattgggcgggtgatgcttttgatatctggggccaagggacaatggtcaccgtctcttca

SEQ ID NO: 2484 - DNA, 324 bp, Homo sapiens
tcttctgagctgactcaggaccctgctgtgtctgtggccttgggacagacagtcaggatcacatgccaaggagacagtctcagaatctattatgcaaactggtaccagcagaagccaggacaggcccctgtacttgtcatctatgatgaaaacaaccggccctcagggatcccagaccgattctctggctccagctcaggaaacacagcttccttgaccatcactggggctcaggcggaagatgaggctgactattactgtaactcccgggacagcagtagtaaccgcgtagtattcggcggagggaccaagctgaccgtccta

SEQ ID NO: 2485 - DNA, 372 bp, Homo sapiens
gaggttcagctggtggagtctgggggaggcttggtacagcctggagggtccctgagactctcctgtgcagcctctggattcaccttcagtagttatgaaatgaactgggtccgccaggctccagggaaggggctggagtgggtttcattcattagtagcagtggtagtaccatatactacgcagactctgtgaagggccgattcaccatctccagagacaacgccaagaactcactgtatctgcaaatgaacagactgagagccgaagacacggctatttattactgtgcgagagagccccaaggacctggttactactactactactacatggacgtctggggcaaagggaccacggtcaccgtctcctca

SEQ ID NO: 2486 - DNA, 336 bp, Homo sapiens
cagtctgccctgactcagcctgcctccgtgtctgggtctcctggacagtcgatcaccatctcctgcactggaatgagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagaaccactttcccttatgtcttcggaactgggaccaaggtcaccgtccta

SEQ ID NO: 2487 - DNA, 381 bp, Homo sapiens
caggtgcagctggtggagtctgggggaggcgtggtccagcctgggaggtccctgagactctcctgtgcagcctctggactcaccttcagtagttatggcatgcactgggtccgccaggctccaggcagagggctggagtgggtggcagttatatcatttgatggagttaataaatactatgaggactccgtgaagggccgattcaccatctccagagacaattccaagaacacgatgtatctgcaaatgaacagcctgagagctgaggacacggctgtgtattactgtgcgaaagcctaccggggggatatgattacgtttgggggaattatcgcgccccttgactactggggccagggaaccctggtcaccgtctcctca

SEQ ID NO: 2488 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtagcaccaatcggccttcaggggtccctgaccgattctctggctccaagtctggcacctcagcctccctggccatcactgggctccaggctgaggatgaggctgattattactgccagtcctatgacagcagcctgagtgtcttggtcttcggaactgggaccaaggtcaccgtccta

SEQ ID NO: 2489 - DNA, 366 bp, Homo sapiens
caggtgcagctggtgcagtctggggctgaggtgaagaagcctgggtcctcggtgaaggtctcctgcaaggcttctggaggcaccctcagcagctatgctatcagctgggtgcgacaggcccctggacaagggcttgagtggatgggagggatcatccctatctttggcacagcaaactacgcacagaagttccagggcagagtcacgattaccgcggacgaatccacgagcacagcctacatggagctgagtagcctgagatctgacgacacggccgtgtattactgtgtgagaacgatgggctatgacagtagtggttattacgaggactactggggccagggaaccctggtcaccgtctcctca

SEQ ID NO: 2490 - DNA, 327 bp, Homo sapiens
gaaattgtgttgacacagtctccagccaccctgtctttgtctccaggggaaagagccaccctctcctgcagggccagtcagagtgttagcagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgaggctcaccttcggccaagggacacgactggagattaaa

SEQ ID NO: 2491 - DNA, 363 bp, Homo sapiens
cagatgcagctggtgcagtctggggctgaggtgaagaagactgggtcctcagtgaaggtttcctgcaaggcttccggatacaccttcacctaccgctacctgcactgggtgcgacaggcccccagacaagcgcttgagtggatgggatggatcacacctttcaatagtaacaccaagtacgcacagaaattccaggacagagtcaccattaccagggacaggtctatgagcacagcctacatggagctgagcagcctgagatctgaggacacagccatttattactgtgcaactcattccgaagacttctactactactacatggacgtctggggcaaagggaccacggtcaccgtctcctca

SEQ ID NO: 2492 - DNA, 330 bp, Homo sapiens
cagtctgccctgactcagcctccctccgcgtcggggtctcctggacagtcagtcaccatctcctgcactggaaccagcagtgacgttggtggttataactatgtctcctggtaccaacagcacccaggcagagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagtaataatctcgtgttcggcggagggaccaagctgaccgtccta

SEQ ID NO: 2493 - DNA, 372 bp, Homo sapiens
gaggtgcagttgtcgcagtctgggggaggcttggttcagcctggggggtccctgagactctcctgtgaagcctctggattcacctttaagaactatgccatgacctgggtccgccaggctccagggaaggggctggagtgggtctcaagtatttatggtagtggcggtgccagatactacgcagactccgtgaagggccgattcaccatctccagagacaactctcggaacacactgtatctacagttgaccgacctgggagccgcggacacggccatatattactgtgcgaaagatcgccacgccgacgtcttgttatggttcggggaggtttcgcactggggccagggagccctggtcaccgtctcctca

SEQ ID NO: 2494 - DNA, 333 bp, Homo sapiens
cagtctgccctgactcagcctgcctccgtgtctgggtctcctggacagtcgatcaccatctcctgcactggcaccatcaatgatattgagatttataagcaggtctcctggtaccagcaaaaagcaggcaaagtccccgaactcatcatttatgaggtcactgagcggccctcagggatttctgctcgcttctctggctccaagtctggcaatacggcctccctgacaatctccggcctccaggctgaggacgagggcgattattattgctgttcatatgcaggtcctggggcttttgtactcttcggcggcgggaccaagctgaccgtcctg

SEQ ID NO: 2495 - DNA, 384 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggggaaatctatcatagtgggagcgccaactacaacccgtccctcaagagtcgagtcaccatatcagtagacaagtccaagaaccagttctccctgaggctgaactctgtcaccgccgcggacacggccgtgtattactgtgcgaggaagagcagtgcatacagctatcgttacgccgaaccccgggaatactactttgactactggggccagggaaccctggtcaccgtctcctca

SEQ ID NO: 2496 - DNA, 333 bp, Homo sapiens
cagtctgtgttgacgcagccgccctcagtgtctgcggccccaggacagaaggtcaccatctcctgctctggaagcagctccaacattgggaataattatgtctcctggtaccagcaactctcaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgccttttatgtcttcggaactgggaccaaggtcaccgtccta

SEQ ID NO: 2497 - DNA, 363 bp, Homo sapiens
gaggtgcaggtggtggagtctgggggaggcttggtccagcctggggggtcccggagactctcctgtacagcctctggattcaccttgagtaattattggatgagctgggtccgccaggctccagggaaggggcttgagtgggtggccaacataaagcaagatggaagtgagaaatactatgtggactctgtgaagggccgattcaccatctccagagacaacgccaagaattccctgtatctgcaaatggacagcctgagagccgaggacacggctgtctattactgtgcgagaggagggagatattgtcctggtggtagttgccctaagtggggccggggaaccctggtcaccgtctcctca

SEQ ID NO: 2498 - DNA, 324 bp, Homo sapiens
gacatccagatgacccagtctccatcctccctgtctgcatctgtaggagacagagtcaccatcacttgccaggcgagtcaggacattagtaattttttaaattggtatcagcagaaaccaggagaagcccctaaactcctgatcttcgatgcgtccaaattggaaacaggggtcccatcaaggttcagtggaagtggatttgggacagattttactttcaccatcagcagcctgcagcctgaagacattgcaacatattactgtcaacaatatgatgatctcacttcgatcaccttcggccaagggacacgactggagatcaaa

SEQ ID NO: 2499 - DNA, 363 bp, Homo sapiens
caggtgcagctggtggagtctgggggaggcgtggtccagcctgggaagtccctgagactctcctgtgcagcgtctggattcaccttcagtagctatgacatgcactgggtccgccaggctccaggcaaggggctggagtgggtggcagttatctggtctgatggaagtaataaatactatgcagactccgtgaagggccgattcaccatctccagagacaattccaagaacacgctgtatctgcaaatgaacagcctgagagccgacgacacggctgtgtatttttgtacgagggttgcgggacatttgggggagttatcgtcggactactggggccagggaaccctggtcaccgtctcctca

SEQ ID NO: 2500 - DNA, 318 bp, Homo sapiens
tcctatgagctgacacagccaccctcggtgtcagtgtccccaggacagacggccaggatcacctgctctggagatgcatttccaaaccaatatgcttattggtaccagcagaagccaggccaggcccctgtgctgttgatatataaagacagtgagaggccctcagggatccctgagcgattctctggctccagctcagggacaacagtcacgttgaccatcagtggagtccaggcagaagacgaggctgactattactgtcaatcaacagacagcagtggtatgttgttcggcggagggaccaagctgaccgtccta

SEQ ID NO: 2501 - DNA, 366 bp, Homo sapiens
caaatgcagctggtgcagtctgggcctgaggtgaagaagcctgggacctcagtgaaggtctcttgcgaggcttctggattcacttttattagctctgctatgcactgggtgcgacaggctcgtggacaacgccttgagtggataggacggatcgtcgttggcagcggtaacacacactacgcacagaagttccaggaaagagtcaccattaccagggacatgtccaaaagcgcagcctatatggagctgaacagcctgagatccgaggacacggccgtgtattactgtgcggcatcggggggggatagtgggacctatgaaatcggcgaatactggggccagggaaccctggtcaccgtctcctca

SEQ ID NO: 2502 - DNA, 339 bp, Homo sapiens
gacatcgtgatgacccagtctccagactccctggctgtgtctctgggcgagagggccaccatcaactgcaagtccagccagagtgttttgtacagctccaacaataagaactacttagcttggtaccagcagcaaccaggacaccctcctaagctgctcatttactgggcatctacccgggaatccggggtccctgaccgattcagtggcagcgggtctgggacagatttcactctcaccatcaccagcctgcaggctgaagatgtggcagtttattactgtcagcaatattttagtagtcctcccacttttggccaggggaccaagctggagatcaaa

SEQ ID NO: 2503 - DNA, 396 bp, Homo sapiens
caggtgcagctgcaggggtcgggcccaggactggtgaagcctccacagaccctgtccctcacctgcactgtctctggtggctccatcagcagtggtaattactactggagctggatccggcagcccgccgggaagggactggagtggattgggcgtatctattccagtgggagtgggaataccaagtacaacccctccctcaagagtcgagtcaccatatcagtagacacgtccaagaaccagttctccctgaagctgagctctgtgaccgccgcagacacggccgtgtattactgtgcgagcggcgagatactattaacagcagctggtacggaggactactcctactacggtatggacgtctggggccaagggaccacggtcaccgtctcctca

SEQ ID NO: 2504 - DNA, 318 bp, Homo sapiens; identical to SEQ ID NO: 2106

SEQ ID NO: 2505 - DNA, 369 bp, Homo sapiens
caggtgcagctgcaggagtcgggcccaggactggtgaagccttcggagaccctgtccctcacctgcactgtctctggtgtctccatcagtagttacttctggagctggatccggcagcccccagggaagggactggagtggattgggtatatctattacactgggagcaccaactacaacccctccctcaagagccgagtcaccatatcagtagacacgtccaagaaccagttctccctgaagctgagctctgtgaccgctgcggacacggccgtgtattattgtgcgagaggggatagcagtggctggtacgggaacccatatcactttgactactggggccagggaaccctggtcaccgtctcctca

SEQ ID NO: 2506 - DNA, 330 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaacaacggcccccaaactcctcatctatagtaataatcagcggccctcaggggtccctgaccgattctctggctccaagtctggcacctcagcctccctgtccatcagtgggctccagtctgaggatgaggctgattattactgtgcagcatgggatgacagcctgaatggtccggtgttcggcggagggaccaagctgaccgtccta

SEQ ID NO: 2507 - DNA, 387 bp, Homo sapiens
gaggtgcagctgttggagtctgggggaggcttggtacagcctggggggtccctgagactctcctgtgcagcctctggattcacctttagcaactatgccatgagctgggtccgccagtctccagggatggggctgcattgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaatcccgccgtaccattacgatattttgactggttatcaactcccatactactttgactactggggccagggaaccctggtcaccgtctcctca

SEQ ID NO: 2508 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttgggtgttcggcggagggaccaggctgaccgtccta

SEQ ID NO: 2509 - DNA, 378 bp, Homo sapiens
caggtccagctggtgcagtctggggctgaggtgaagaagcctgggtcctcggtgaaggtctcctgcaaggcttctggaggcaccttcagcagctatggtatcacctgggtgcgacaggcccctggacaagggcttgagtggatgggaaggatcatccctatccttggtatagcagactacgcacagaagttccagggcagagtcacgattaccgcggacaaatccacgagcacagcctacatggagctgagtagcctgagatctgaggacacggccttttattactgtgcgagagaggggtgggattgtagtggtggtagctgcaacgactactactttgactactggggccagggaaccctggtcaccgtctcctca

SEQ ID NO: 2510 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtccta

SEQ ID NO: 2511 - DNA, 354 bp, Homo sapiens
gaggtgcagctggtggagtctgggggaggcctggtcaagcctggggggtccctgagactctcctgtgcagcctctggattcaccttcactagctatagcatgaactgggtccgccaggctccagggaaggggctggagtgggtctcatccattagtggtggttctagttacatatactacgcagactcagtgaggggccgattcaccatctccagagacaacgccaagaactcactgtatctgcaaatgaacagcctgagagccgaggacacggctgtgtattactgtgcgagaggggctgggagctactggtttgactactggggccagggaaccctggtcaccgtctcctca

SEQ ID NO: 2512 - DNA, 324 bp, Homo sapiens
gaaattgtgttgacgcagtctccaggcaccctgtctttgtctccaggggaaagagccaccctctcctgcagggccagtcagagtgttagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgttttactgtcagcagtatgctggctcaccgctcactttcggcggggggaccaaggtggagatcaaa

SEQ ID NO: 2513 - DNA, 366 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaactattagtggtagtggtggtagcacatactacgcagactccgtgaagggccggttcaccatctccagagacaattccaagaacacgctgtatctgcaaatgaacagcctgagagccgaggacacggccgtatattactgtgcgaaagttacgtttggggacctagaacgcctggggtgggactactggggccagggaaccctggtcaccgtctcctca

SEQ ID NO: 2514 - DNA, 336 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatccagggggaatgttcggcggagggaccaagctgaccgtccta

SEQ ID NO: 2515 - DNA, 393 bp, Homo sapiens
cagctgcagctgcaggagtcgggcccaggactggtgcagccttcggagaccctgtccctcacctgcattgtctctggtggctccatcagcagtagcagttactactggggctggatccgccagcccccagggaaggggctggagtggattgggactatctattatagtgggagcacctactacaacccgtccctcaagagtcgagtcaccatatccgtagacacgtccaagaaccagttctccctgaagctgagctctgtgaccgccgcagacacggctctgtattactgtgcgagaccccactcctattactatccttcggggagttatcatggccggttccttaactggttcgacccctggggccagggaaccctggtcaccgtctcctca

SEQ ID NO: 2516 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacatcaatcggccctcaggggtccctgaccgattctctggctccaagtctggcacctcagcctccctggccatcactgggctccaggctgaggatgaggctgattattactgccagtcctttgacagcagcctgagtggtcctgtggtcttcggcggagggaccaagctgaccgtccta

SEQ ID NO: 2517 - DNA, 369 bp, Homo sapiens
gaagtgcagctggtggagtctgggggagtcgtggtacagcctggggggtccctgagactctcctgtgcagcctctggattcagctttgatgattataccatacactgggtccgtcaagctccggggaagggtctggagtgggtctcttttgttagttgggatggtggtagcacatactatgcagactctgtgaagggccgattcaccatctccagagacaagagcaaaaaatccctgtatctgcaaatgaacagtctgagaactgaggacaccgccttgtattactgtgcaagagaggatagtagtggttacccctctgtgtcctactttgactactggggccagggaaccctggtcaccgtctcctca

SEQ ID NO: 2518 - DNA, 324 bp, Homo sapiens; identical to SEQ ID NO: 2024

SEQ ID NO: 2519 - DNA, 357 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacaacaaactacgcacagaagttccagggcagagtcacgattaccgcggacgaatccacgagcacagcctacatggagctgagcagcctgagatctgaggacacggccgtgtattactgtgcgatattgagacatgttttgcagcagctcgattactggggccagggaaccctggtcaccgtctcctca

SEQ ID NO: 2520 - DNA, 327 bp, Homo sapiens
gaaattgtgttgacacagtctccagccaccctgtctttgtctccaggggaaagagccaccctctcctgcagggccagtcagagtgttagcagctacttagcctggtaccaacagaaacttggccaggctcccaggctcctcatctatgatgcatccaacagggccactggcatcccagccaggttcagtggcagtgggtctgggacagacttcactctcaccatcagcagcctagagcctgaagattttgcagtttattactgtcagcggggtagcaactggcctccgaggctcactttcggcggagggaccaaggtggagatcaaa

SEQ ID NO: 2521 - DNA, 375 bp, Homo sapiens
cagctgcagctgcaggagtcgggcccaggactggtgaagccttcggagaccctgtccctcacctgcactgtctctggtggctccatcaacagtagtacttactactggggctggatccgccagcccccagggaaggggctggagtggattgggactatctattatagtgggagcacctactacaagtcgtccctcaagagtcgagtcattatatccgtagacacgtccaagaaccaattctccctgaaactgagctctgtgaccgccgcagacacggctgtgtattactgtgcgagagtttggggcagcagctggagaggaaggcggtgggacttcgacccctggggccagggaaccctggtcaccgtctcctca

SEQ ID NO: 2522 - DNA, 321 bp, Homo sapiens
gacatccagatgacccagtctccatcctccctgtctgcatctgtaggagacagagtcaccatcacttgccgggcaagtcagagcattagcaactatttaaattggtatcagcaagaaccagggagagcccctaagctcctgatctatgctgcatccagtttgcaaagtggggtcccatcaaggttcagtggcagtggttctgagacagatttcactctcaccatcagcagtctgcaacctgaagattttgcaacttatcactgtcaacagagttacagtaccccttggacgttcggccaagggaccaaggtggagatcaaa

SEQ ID NO: 2523 - DNA, 381 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggtagttatatcatatgatgcaaatactaaatactatgcagactccgtgaagggccgattcaccatctccagagacaattccaagaacacgctgaatctgcaaatgaacagcctgagagctgaggacacggctgtgtattactgtgcgagagcctaccggggggagatgattacgtttgggggagttatcgcgccccttgactactggggccagggaaccctggtcaccgtctcctca

SEQ ID NO: 2524 - DNA, 333 bp, Homo sapiens
cagtctgtgctgacgcagccgccctcagtgtctggggccccagggcagagggtcaccatctcctgcactgggagcagctccaacatcggggcaggttatgatgtattttggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcaccctgagtgtcttggtcttcggaactgggaccaaggtcaccgtccta

SEQ ID NO: 2525 - DNA, 372 bp, Homo sapiens
caggtgcagctacaccagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaaacaccaactacaacccgtccctcaagagtcgagtcaccatatcagtagacacgtccaagaacgaggtctccctgaagctgagctctgtgaccgccgcggacacggctgtgtattactgtgcgagaggcctaggggcatatagcagcaggtggttcttgtctttctttgactactggggccagggaaccctggtcaccgtctcctca

SEQ ID NO: 2526 - DNA, 339 bp, Homo sapiens
gacatcgtgatgacccagtctccagactccctggctgtgtctctgggcgagagggccaccatcagctgcaagtccagccagactgttttatacaggtccagcaataagaactacttagcttggtaccagcagaaaccaggacagcctcctaagctgctcatttactgggcatctacccgggaatccggggtccctgaccgattcagtggccgcgggtctgggacagatttcactctcaccatcagcagcctgcaggctgaagatgtggcagtttattactgtcagcaatattatagtactcctaagactttcggcggagggaccaaggtggagatcaaa

SEQ ID NO: 2527 - DNA, 351 bp, Homo sapiens
gaggtgcagctggtggagtctggaggaggcttgatccagcctggggggtccctgagactctcctgtgcagcctctgggctcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctctatcttcaaatgaacagcctgagagccgaggacacggccgtgtattactgtgcgagagatctttatgttcgggggctggacgtctggggccaagggaccacggtcactgtctcctca

SEQ ID NO: 2528 - DNA, 318 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacagcttaatagttaccccactttcggccctgggaccaaagtggatatcaaa

SEQ ID NO: 2529 - DNA, 378 bp, Homo sapiens
gaggtgcagctggtggagtctgggggaggcttggtacagcctggggggtccctgagactctcctgtgcagcctctggattcaccttcagtagctattacatgaactgggtccgccaggctccagggaaggggctggagtgggtttcatacattagtagtggtagtagtatcatatactacgcagactctgtgaagggccgattcaccatctccagagacaatgccaagaactcactgtatctgcaaatgaacagcctgagagacgaggacacggctgtgtattactgtgcgagagattcccctctacgatattttgactggcaactcgggggggggtttgactactggggccagggaaccctggtcaccgtctcctca

SEQ ID NO: 2530 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagtctttgggtgttcggcggagggaccaagctgaccgtccta

SEQ ID NO: 2531 - DNA, 378 bp, Homo sapiens
caggtgcagctgcaggagtcgggcccaggactggtgaagccttcacagaccctgtccctcacctgcactgtctctggtggctccatcagcagtggtagtaacttctggagctgggtccggcagcccgccgggaagggactggagtggattgggcgtatctttaccactgggagcaccaactacaacccctccctcaagagtcgagtcaccatatcattagacaggtccaagaaccaattctccctgaagctgagctctgtgaccgccgcagacacggccgtgtattactgtgcgagagatgaaggttcggggagtctactctactaccactactacatggacgtctggggcaaagggaccacggtcaccgtctcctca

SEQ ID NO: 2532 - DNA, 330 bp, Homo sapiens
cagtctgtgctgactcagccaccctcagcgtctgggacccccgggcagagggtcaccatctcttgttctggaagcagctccaacatcggaagtaattatgtatactggtaccagcaactcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggagggaccaagctgaccgtccta

SEQ ID NO: 2533 - DNA, 372 bp, Homo sapiens
gaggtgcagctggtggagtctgggggaggcctggtcaagcctggggggtccctgagactctcctgtgcagcctctggattcaccttcagtagctataccatgaactgggtccgccaggctccagggaaggggctggagtggctctcatccattagtagtagtagaaattacatatactacgcagactcagtgaagggccgattcaccatctccagagacaacgccaagaactcactgtatctgcaaatgaacagcctgagagccgaggacacggctgtgtattactgtgcgagagatggatatagcagcagctggtactcctactactactttgacttctggggccagggaaccctggtcaccgtctcctca

SEQ ID NO: 2534 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttcctatgtggtattcggcggagggaccaagctgaccgtccta

SEQ ID NO: 2535 - DNA, 372 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagtatagggtatgcggactctgtgaagggccgattcaccatctccagagacaatgccaagaactccctgtatctggaaatgaacagtctgagagctgaggacacggccttgtattactgtttctccgtccctccacttagtctatttggggggacttactggttcgacccctggggccagggaaccctggtcaccgtctcctca

SEQ ID NO: 2536 - DNA, 333 bp, Homo sapiens
aattttatgctgactcagccccactctgtgtcggagtctccggggaagacggtaaccatctcctgcacccgcaacagtggcagcattgcccgcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctgcactgaagactgaggacgaggctgactactactgtcagtcttatgatggcagcaagtttggggtgttcggcggagggaccaagctggccgtccta

SEQ ID NO: 2537 - DNA, 375 bp, Homo sapiens
gaggtgcagttgttggagtctgggggaggcttggtacagcctggggggtccctgagactctcctgtgcagcctctggattcacctttagcacctatgccatgagctgggtccgccaggctccagggaaggggctggagtgggtctcaggtattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataccggtatattactatggttcggggagttatcgggcgtggactattggggccagggaaccctggtcaccgtctcctca

SEQ ID NO: 2538 - DNA, 333 bp, Homo sapiens
cagtctgtgctgacgcagccgccctcagtgtctggggccccagggcagagggtcaccatctcctgcactgggagcagctccaacatcggggcacgttatgatgtattttggtaccggcagcttccaggaacagcccccaaactcctcatctatggtagcaacaatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtccga

SEQ ID NO: 2539 - DNA, 372 bp, Homo sapiens
gaggtgcagttgttggagtctgggggaggcttggtacagcctggggggcccctgagactcgcctgtgcagtctctggattcacctttagtagttatgccatgacctgggtccgccaggctccagggaaggggctggagtgggtctcaagtattagtggtagtggtgataacacatactacgcagactccgtgaagggccgcttcaccatctccagagacaattccaggaacacgctgtatctgcaaatgaacagcctgagagccgaggacacggccgtatattactgtgcgaaagtgtccagtaagtggcaatactactactattattacatggacgtctggggcaaagggaccacggtcaccgtctcctca

SEQ ID NO: 2540 - DNA, 327 bp, Homo sapiens
gaaattgtgttgacgcagtctccaggcaccctgtctttgtctccaggggacagagccaccctctcctgcagggccagtcagagtgttaggattagcttcttagcctggtaccagcagaaacctggccaggctcccaggctcctcatctatggtgcatccagcagggccactggcatcccagacaggttcagtggcaatgggtctgggacagacttcactctcaccatcagcagactggagcctgaagattttgcagtgtattactgtcagcactatggtagctcacccccgtacacttttggccaggggaccaagctggagatcaaa

SEQ ID NO: 2541 - DNA, 345 bp, Homo sapiens
gaggtgcagctggtggagtctgggggaggcttggtccagtcgggggggtccctgagactctcctgtgcagtctctggattcaacgtcaatagcaactacctgagctgggtccgccaggctcctgggaaggggctggagtgggtctcaattatctatagcgatggtatcacatactacgcagactccgtgaagggccgattcaccatctccagagacaattccaagaacacgctgtatcttcaactgaacagcctgagaactgaggacacggctgtgtatttctgtgcgagatcggcgggttacatggacgtctggggcaaagggaccacggtcatcgtctcctca

SEQ ID NO: 2542 - DNA, 318 bp, Homo sapiens
gaaatagagatgacgcagtctccagccaccctgtctgtgtctccaggggaaagagccaccctctcctgcagggccagtcagagtgttagtagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcaacagtataatgactggccttcgttcggcctggggaccaaggtggaaatcaaa

SEQ ID NO: 2543 - DNA, 363 bp, Homo sapiens
caggtgcagctggtggagtctgggggaggcttggtcaagcctggagggtccctgagactctcctgtgcagcctctggattcaccttcagtgactactacatgagctggatccgccaggctccagggaaggggctggagtgggtttcatacattagtagtagtactaataccatatactacgcagactctgtgaagggccgattcaccatctccagggacaacgccaagaactcagtgtatctgcaaatgaacagcctgagagccgaggacacggccgtgtattactgtgcgagagatcgggtagtgggagctaggggcgacaacgacccctggggccagggaaccctggtcaccgtctcctca

SEQ ID NO: 2544 - DNA, 330 bp, Homo sapiens
cagtctgccctgactcagcctgcctccgtgtctgggtctcctggacagtcgatcaccatctcctgcactggaaccagcagtgatattgggagttataaccttgtctcctggtaccaacagcacccaggcaaagcccccaaactcatgatttatgaggtcagtaggcggccctcaggggtttctaatcgcttctctggctccaagtctggcaacacggcctccctgacaatctctgggctccaggctgaggacgaggctgattattactgctgctcatatgcaggtagtagtacttcttctttcggcggagggaccaagctgaccgtccta

SEQ ID NO: 2545 - DNA, 366 bp, Homo sapiens
gaggagcagctgttggagtctgggggagacttggtacagcctggggggtccctgagactctcctgtgcagcctctgcattcacctttaacaactatgccatgagctgggtccgccaggctccagggaaggggctggagtgggtctcaggtattagtggtagtggtaatagcacatcctacgcagactccgtgaagggccggttcaccatctccagagacagttccaagaacacgttatatctgcaaatgaacagcctgagagccgaggacacggccgtatattactgtgcgaaagacttgtaccagctcccctgggggaatgcttttgatatctggggccaagggacaatggtcaccgtctcttca

SEQ ID NO: 2546 - DNA, 327 bp, Homo sapiens
tcctatgtgctgactcagccaccctcggtgtcagtggccccaggaaagacggccaggattacctgtgggggaaacaacattggaagtaaaagtgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggggatgaggccgactattactgtcaggtgtgggatggtagtagtgatccccattgggtgttcggcggagggaccaaactgaccgtccta

SEQ ID NO: 2547 - DNA, 390 bp, Homo sapiens
caggtcaccttgagggagtctggtcctgcgctggtgaaacccacacagaccctcacactgacctgcaccttctctgggttctcactcaccactagtggaatgtgtgtgagctggatccgtcagcccccagggaaggccctggagtggcttgcactcattgattgggctgatgataaatactacagcacatctctgaagaccaggctcaccatctccaaggacacctccaaaaaccaggtggtccttacaatgaccgacatggaccctgtggacacagccacgtattactgtgcacggacccgtcccactggatatagtggctacgatttcggttttccggaggcgttcttcgacccctggggccagggaaccctggtcaccgtctcctca

SEQ ID NO: 2548 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcccttgacgttcggccaagggaccaaggtggaaatcaaa

SEQ ID NO: 2549 - DNA, 384 bp, Homo sapiens
cagctgcggctgcaggagtcgggcccaggactggtgaagccttcggagaccctgtccctcacctgcactgtctctggtggctccatcagcagtagtaatttctactggggctggatccgccagcccccagggaaggggctggagtggattgggagtatctattatagtgggagcacccactacaacccgtccctcaagagtcgagtcaccgtatccgtagacacgtccaagaaccagttctccctgaagctgagctccgtgaccgccgcagacacggctgtgtattactgtgcgagacttacgtattactatgatagtagtggtttcatccgcgccgagccttttgactactggggccagggaatcctggtcaccgtctcctca

SEQ ID NO: 2550 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttttttgttcacttttggccaggggaccaagctggagatcaaa

SEQ ID NO: 2551 - DNA, 357 bp, Homo sapiens
cagatcaccttgaaggagtctgggcctccgctggtggaacccaaacagaccctcaggctgacctgcagcttctctgggttctccctcacaactaatggagaggctgtgggctggatccgtcagccccccggaaaggccctggagtggctcgcactcattcattgggatgacgataagtggtacagcccatctctgaggaacagactcaccatcaccagggacacctccaaaaaccaggttgtccttacaatgaccaacgtggaccctgtggacacagccacatattactgtgcacacagggcagttatcttaaactttgatcactggggccagggacttctggtcaccgtctcctca

SEQ ID NO: 2552 - DNA, 321 bp, Homo sapiens
ttctatgagctgactcagccaccctcagtgtccgtgtccccaggacagacagccggcatcacctgctctggagataaattgggacataaatatgtttattggtatcaacagaagccaggccagtcccctatactgctcatctatcaggatgacaagcggccctcagggatccctgagcgattctctggctccaactctgggactatagccactctgaccatcagcgggacccagcctgtggatgaggctgactattactgtcaggcgtgggacaacgacgctggggtggtgttcggcggagggaccaagctgaccgtcctt

SEQ ID NO: 2553 - DNA, 378 bp, Homo sapiens
caggtacaattggtacaatctgggtctgagttgaaggagcctggggcctcagtgaaggtctcctgcaagaccactggacacagtttcgatagttacgcaattaattgggtgcgacaggccccgggacaaggacttgagtggatgggatggctcaacacccacactgggaggcccacatatgtccagggcctcacaggacgttatgtcttttctttggacacctctgtcagcacggcatatcttgagatcaatagtctagagactgaggacactgccttttattactgtgcgcgaggccccatggttgcgttggaccagcgactggcattcaactacttcgacccctggggccagggaaccctggtcaccgtctccgca

SEQ ID NO: 2554 - DNA, 330 bp, Homo sapiens
aactttatactgactcagccccactctgtgtcggagtctccggggaagacgataattatctcctgcaccggcgccggtggcaacattgccagcaactatgtgcagtggtaccgacagcgcccgggcagtgcccccactactgtgatttttgaggatgaccaaagaccctctggggtccctgatcggttctctggctccatcaacgcctcctccaattctgcctccctcaccattactggactgaggactgaggacgaggctgactactactgtcaatcttttggaaataacaatgtcttattcggcggagggaccaggctgaccgtccta

SEQ ID NO: 2555 - DNA, 378 bp, Homo sapiens
cagctgcagctgcaggagtcgggcccaggactggtgaagccttcggagaccctgtccctcacctgcactgtctctggtggctccatcagcagtagtacttactattggggctggatccgccagcccccagggaaggggctggagtggattgcgagtatctattatagtgggggcacctactacaacccgtccctcaagagtcgagtcaccatatccgtagacacgtccaagaaccagtactccctgaagcggagctctgtgaccgccgcagacacggctgtgtattactgtgcgagactgcccgatttttggagtggaagggcaggctactactacatggacttctggggcaaagggaccacggtcaccgtctcctca

SEQ ID NO: 2556 - DNA, 330 bp, Homo sapiens; identical to SEQ ID NO: 1976

SEQ ID NO: 2557 - DNA, 378 bp, Homo sapiens
gaagtgcaactggtggcgtctgggggaggcgtggtacagccgggggggtccctgagactctcctgtgcagtctctggattcacctttgatgattatgccatgcactgggtccgtcaggttccagggaagggtctgaagtgggtctctcttattagtggggatggtgatagcacatactatgcagactctgtgaagggccgattcaccatctccagagacaacagcaaaaactccctctatctgcaaatgaacagtctgagaagtgaggacaccgccttctattactgtgcaaaagatatatcgtcctgggaccagctgctatcagttttgagtgcttttgatatctggggccaagggacaatggtcaccgtctcttca

SEQ ID NO: 2558 - DNA, 321 bp, Homo sapiens
gacatccagatgacccagtctccatcctccctgtctgcatctgtaggagacagagtcaccatcacttgccaggcgagtcaggacattagtaactttttaaattggtatcaacagaaaccagggaaagcccctaaactcctgatctacgatacatccaatttggaaacaggggtcccatcaaggttcagtggaagtggatctgggacagattttactttcaccatcagcagcctgcagcctgaagatattgcaacatattactgtcaacagtttgataatctccctctcactttcggcggagggaccaaggtggagatcaaa

SEQ ID NO: 2559 - DNA, 357 bp, Homo sapiens
caggtccaacttgtgcagtctggggctgaggtgaagaagcctggggcctcagtgaaggtttcctgcaaggcttctggatacaccttcactgcctatgctatacattgggtgcgccaggcccccggacaagggcttgagtggatgggaaggatcaactctggcactggtgacacaaaatattcacagaagttccagggcagagtcaccattaccagggccacaaccgcgagcacagcctacatggagttgagcagcctgagatctgaagacacggctgtctattactgtgcgagaagtccgacggtccttcttgcctttgactactggggccagggaagcctggtcaccgtctcctca

SEQ ID NO: 2560 - DNA, 321 bp, Homo sapiens
gacatccagatgacccagtctccttccaccctgtctgcatctgtaggagacagagtcaccatcacttgccgggccagtcagagtattagtagctggttggcctggcatcagcagaaaccagggaaagtccctaagctcctgatctataaggcgtctagtttagaaagtggggtcccatcaaggttcagcggcagtggatctgggacagaattcactctcaccatcagcagcctgcagcctgatgattttgcaacttatttctgccaacagtataatagtgatcccctcactttcggcggagggaccaaggtggagatcaag

SEQ ID NO: 2561 - DNA, 351 bp, Homo sapiens
caggtgcagctgcaggagtcgggcccaggactggtgaagccttcggagaccctgtccctcacctgcactgtctctggtggctccatcagtagtaactactggagctggatccggcagcccccagggaagggactggagtggattgggtatatctattacagtgggaacaccaactacaacccctccctcaagagtcgagtcaccatatcagtagacacgtccaagaaccagttctccctgaagctgagctctgtgaccgccgcagacacggccgtgtatttctgtgcgagaacccctttattttacactatggacgtctggggccaagggaccacggtcaccgtctcctca

SEQ ID NO: 2562 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagagccactggcagcccagacaggttcagtggcagtgggtctgggacagacttcactctcaccatcagcagactggagcctgaagattttgcagtgtattactgtcagcagtatggtagttcaccgtacacttttggccaggggaccaagctggagatcaaa

SEQ ID NO: 2563 - DNA, 363 bp, Homo sapiens
caggtccagctggtacagtctggggctgaggtgaagaagcctggggcctcagtgaaggtctcctgcaaggtttccggatacaccctccctgaattatccatccactgggtgcgacagactcctggaaaagggcttgagtggatgggaggttttgatcctgaagatggtgaaacaatctatgcacagaagttccagggcagagtcaccatgaccgaggacacgtctacagacacagcctacatggacctgagcagcctgagatctgaggacacggccgtctactactgtgcaacatcgactgccctattgcctaagtactggttcgacccctggggccagggaaccctggtcaccgtctcctca

SEQ ID NO: 2564 - DNA, 330 bp, Homo sapiens
cagtctgtgttgacgcagccgccctcagtgtctgcggccccaggacagaaggtcaccatctcctgctctgggagcagctccaacattgggaataattatgtatcctggtaccagcagctcccaggaacaacccccaaactcctcatttatgacaataatgagcgaccctcagggattcctgaccgattctctggctccaagtctggcacgtcagccaccctgggcatcaccggactccagactggggacgaggccgattattactgcggaacatgggatagcagcctgagtgctgtggtattcggcggagggaccacgctgaccgtccta

SEQ ID NO: 2565 - DNA, 381 bp, Homo sapiens
cagttgcagctgcaggagtcgggcccaggactggtgaagccttcggagaccctgtccctcacctgcacaatctctggtgcctccgtgagcactaatacttaccactggggctgggtccgccagcccccaggaaaggggctggagtggattgcgactttctacaatactggggccaccctctccaacccgtcgctcaagagtcgagtcaccattgccctggacacgtccaagaaccagttctccctgaatctaatctctgtgaccgccgcagacacggctgtctattattgtgcgagacacaaaaaatgtaatggacatgactgcatctcaaactggtacttcgaggtatggggccgaggcaccctggtcagtgtctcctca

SEQ ID NO: 2566 - DNA, 333 bp, Homo sapiens
cagtctgccctgactcagcctccctccgcgtccgggtctcctggacagtcagtcaccatctcctgcactggaaccagcagtgtcattggtgctaataactatgtctcctggtaccaacaacacccaggcaaagcccccaaactcttgatttatgacgtcgataagcggccctcaggggtccctgatcgcttctctggctccaagtctggcaacacggcctccctgaccgtctctgggctccaggctgaagatgaggctgattattactgcagcacatatgtagacaacaacagccccgcgctattcggcggggggaccaaactgaccgtccta

SEQ ID NO: 2567 - DNA, 384 bp, Homo sapiens
gaggtgcagctggtgcagtctggagcagaggtgaaaaagcccggggagtctctgaagatctcctgtaagggttctggatacagctttaccaactactggatcggctgggtgcgccagatgcccgggaaaggcctggagtggatggggatcatctatcctgttgactctgataccagatacagcccgtccttccaaggccaggtcaccatgtcagccgacaagtccatcaacaccgcctatctgcagtggagcagcctgaaggcctcggacaccgccatgtattactgtgcgagacgacccaggggattagattactatggttcagggtcccccctaggttactttgactactggggccagggaaccctggtcaccgtctcctca

SEQ ID NO: 2568 - DNA, 318 bp, Homo sapiens
gacatccagatgacccagtctccttccaccctgtctgcatctgtgggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataaaagttattggaccttcggccaagggaccaaggtggaaatcaaa

SEQ ID NO: 2569 - DNA, 375 bp, Homo sapiens
caggtcaccttgagggagtctggtcctgcgctggtgaaacccacacagaccctcacactgacctgcaccttctctgggttctcactctctactattggaatgtgtgtgaattggatccgtcagcccccaggaaaggccctggagtggcttgcacgtattgattggactgatgatacaaactacagtccatctctgaggaccaggctcaccatctccaaggacacctccaaaaaccaggtggtcctcacaatgaccaacatggaccctgcggacacagccacctatttctgtgtacgtatccgaggtctcgagagtggattcgactactacggtatggacgtctggggcccagggaccacggtcaccgtctcctca

SEQ ID NO: 2570 - DNA, 321 bp, Homo sapiens
gacatccagatgacccagtctccatctttcgtgtctgcatctgtgggagacagagtcaccatctcttgtcgggcgagtcaggatattagcacctggttagcctggtatcaacagaaaccagggaaagcccctaagctcctgatctttggtgcaaatagtttgcaaagtggggtcccatcaaggttcagcggcagtggatctgggacagatttcactctcaccatcagcagcctgcagcctgaagattttgcaagttacttttgtcaacaggctaaaagtttccccctcactttcggcggagggaccaaaatagagatcaaa

SEQ ID NO: 2571 - DNA, 363 bp, Homo sapiens
caaatgcagctgcaggagtcgggcccgggactggtgaagccttcggagaccctgtccctcacatgtaatgtctttcgtggctccatcgcgattcactactggagctggatccggcagcccccagggaagcgactggaatggattggatttatgcatcccaatgggaccaccaactacaacccctccctcaggagtcgagtcgccttatccatagacacgtccaggagtcagttctccctgaggctgacttctgtgaccgccgcagacacggccgtctatttctgtgcgaagtccacccctggcagaacctggaaagacccctttgacctctggggccagggaaccttggtcgccgtctcctca

SEQ ID NO: 2572 - DNA, 324 bp, Homo sapiens
gaaattgtattgacgcagtctccaggcaccctgtctttgtctccaggagaaagagccaccctctcatgcagggccagtcagactattagcaccgatttcttagcctggtaccagcaaaaacgtggccaggctcccaggctcctcatctttgccacatccgtcagggccactggcatcccagacaggttcattgggagtgggtctgggacagacttcactctcactatcagcagggtggaggctgaagactttgcaatgtattactgccaacaatatgatacctcaccacggaccttcggccaagggaccgcggtggatttcaaa

SEQ ID NO: 2573 - DNA, 387 bp, Homo sapiens
caggtgcagctgcaggaggcgggcccaggactggtgaagccttcggagaccctgtccctcacctgcactgtctctggtgactccatcagcagctctaataaacattggggctggttccgccagccccccggggaggggctagagtggattgggactatcttttctacagggaccacctactccaggtcgtccctcaagagtcgagtcaccctttccgtggacacgtccaagaaccagttctccttgaagttgatctctgtgactgccgcagacacggctgtgtattggtgtgtgagacagccctcgtgggaacgtggtggtactttgttccccgactacttcggtctggaagtctgggggcaggggaccacggtcagcgtctcctca

SEQ ID NO: 2574 - DNA, 336 bp, Homo sapiens
gacattgtgatgactcagtctccgctctccctgcccgtcacccctggagagccggcctccatctcctgcaggtctagtcagagcctcctgaatagtaatggacacaattatttggattggtacttgcagaagccagggcaatctccacagctcctgatctatttgggttttcatcgggcctccggggtccctgacaggttcagtggcagtggatcaggcactgattttacactgaaaatcagcagagtggaggctgaagatgttggtatgtattactgcatgcaagctcgacaagctcctcccacgttcggccaagggaccagggtggaaatcaaa

SEQ ID NO: 2575 - DNA, 363 bp, Homo sapiens
caggtgcagctggtggagtctgggggaggcgtggtccagcctgggaggtccctgagactctcctgtgcagcctctggattcaccttcaatatctatgctatgcactgggtccgccaggctccaggcaaggggctggagtgggtggcagttatatcatatgatggagataatcaatactactcagactccgtgaagggccgattcaccatctccagagacaattccaagaacacgctatatctgctaatgaacagcctgagagctgaggactcggctctgtattactgtgcgaggccgcagggtgggaactactttcaggcccttgactactggggccagggaaccctggtcaccgtctcctca

SEQ ID NO: 2576 - DNA, 321 bp, Homo sapiens
gaaattgtgttgacgcagtctccaggcaccctgtctttgtctccaggggacagagccaccctctcctgcagggccagtcagagtgttagcagcagctacttagcctggtaccagcagaaacctggccaggctcccaggctcctcatctatggtgcatccagcagggccactggcatcccagacaggttcagtggcactgggtctgggacagacttcactctcaccatcagcagactggagcctgaagattttgcagtgtttttctgtcagcgctatggtatatcgtacacttttggccaggggaccaagctggagatcaaa

SEQ ID NO: 2577 - DNA, 366 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagtacgctagtggctacgattttgggttttcactactgggaccagggaaccctggtcaccgtctcctca

SEQ ID NO: 2578 - DNA, 324 bp, Homo sapiens
tcctatgagctgactcagccaccctcagtgtccgtgtccccaggacagacagccagcatcacctgctctggagataaattgggggataaatatgtttgctggtaccagcagaagccaggccagtcccctgtgttggtcatctatcaagatagtaagcggccctcagggatccctgagcgattctctggctccaactctgggaacacagccactctgaccatcagcgggacccaggctatggatgaggctgactatcactgtcaggcgtgggacagcagcactgcctcttatgtcttcggaactgggaccaaggtcaccgtccta

SEQ ID NO: 2579 - DNA, 360 bp, Homo sapiens
caggtgcagctggtggagtctgggggaggcgtggtccagcctgggaggtccctgagactctcctgtgcagcctctggattcaccttcagtagttatggtatgcactgggtccgccaggctccaggcaaggggctggagtgggtggcagttatattctatgatggaagtaataaatactacgcagactccgtgaagggccgcttcaccatctccagagacaattccaagaacacgctgtatctgcaaatgaacagcctgagacctgaggacacggctgtgtattactgtgcgagagacttagaatggagcagtagcggggaggcctactggggccagggaaccctggtcaccgtctcctca

SEQ ID NO: 2580 - DNA, 324 bp, Homo sapiens
tcctatgagctgacacagccaccctcggtgtcagtgtccccacgacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacagacagcagtggtaatcattgggtgttcggcggagggaccaagctgaccgtccta

SEQ ID NO: 2581 - DNA, 381 bp, Homo sapiens
gaggtgcagttggtggagtctgggggaggcctggtcaagcctggggggtccctgagactctcctgtgcagcctctggatttattttgagtccctatagcatgaactgggtccgccaggctccagggaaggggctggagtgggtctcatccattagtagtagtactagttacatacactatgcagactcagtgaagggccgattcaccatctccagagacaacgccaagaactcactgtatctgcaaatgaacagcctgagagccgaggacacggctgtgtattactgtgcgagagacctcgatatcagtgactggcaaagtttcttctactactacggtatggacgtctggggccaagggaccacggtcaccgtctcatca

SEQ ID NO: 2582 - DNA, 324 bp, Homo sapiens
tcttctgagctgactcaggaccctgctgtgtctgtggccttgggacagacagtcaggatcacatgtcaaggagacagcctcagaagctattttgcaagctggtaccaacagaagcccagacaggcccctatacttgtcatctatggtaaatacacccggccctcagggatcccagaccgattctctggctccagtttaggaaacacagcttccttgaccatcactggggctcaggcggaagatgaggctgactatttctgtaactcccgagacagcagtgctcaccatgtggtattcggcggagggaccaagctgaccgtccta

SEQ ID NO: 2583 - DNA, 384 bp, Homo sapiens
gaggtgcagctggtggagtctgggggaggcttggtaaagcctggggggtcccttagactctcctgtgcagcctctggattcactttcagtaacgcttggatgagctgggtccgccaggctccagggaaggggctggagtgggttggccgtattaaaagcaaaactgaaggtgggacaacagactacgctgtacccgtgaaaggcagattcaccatcgcaagagatgattcaaaaaacacgctgtatttgcaaatgaacagcctgaaaaccgaggacacagccgtttattactgtaccacaggaagcggttactatgatattagtgcttattatcaatactactttgactactggggtcagggaaccctggtcaccgtctcctca

SEQ ID NO: 2584 - DNA, 327 bp, Homo sapiens
tcctatgagctgacacagccaccctcggtgtcagtgtccccaggacagacggccaggatcacctgctctggagatgcattgccaaagcaatatgcttattggtaccagcagaggccaggccaggcccctgttttggtgatctataaagacagtgagaggccctcagggatccctcagcgattctctggctccagctcagggacaacagtcacgttgaccatcagtggagtccaggcagaagacgaggcagactattactgtcaatcaggagacagcagtggtacttatggggtggttttcggcggagggaccaagctgaccgtccta

SEQ ID NO: 2585 - DNA, 375 bp, Homo sapiens
gaagtgcagctggtggagtctgggggaggcttggtacagcctggcaggtccctgagactctcctgtgcagcctctggattcacctttgattattatgccatgcactgggtccggcaagctccagggaagggcctggagtgggtctcaggtattagttggaatagtgatagcatagcctatgcggactctgtgaagggccgattcaccatctccagagacagcgccaagaactccctgtatctgcaaatgaacagtctgagagctgaggacacggccttgtattactgtgcaagagatttagggcccccccattgtactggtggtatatgctatccagactactggggccagggaaccctggtcaccgtctcctca

SEQ ID NO: 2586 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcaccccggcaaagcccccaaactcatgatttttgatgtcagtaagcggccctcaggggtttctaatcgcttctctggctccaagtctggcaacacggcctccctgaccatctctgggctccaggctgaggacgaggctgattattactgcagctcatatacaagcagcatcacttgggtgttcggcggagggaccaagctgaccgtccta

SEQ ID NO: 2587 - DNA, 363 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggagaagggcttgagtggatgggaggttttgatcctgaagatggtgaaactatctacgcacagaagttccagggtagagtcaccatgaccgaggacacatctacagacacagcctacatggagctgagcagcctgagatctgaggacacggccgtgtattactgtgcaacgtcggcagctgttaagaggatgatctggttcgacccctggggccagggaaccctggtcaccgtctcctca

SEQ ID NO: 2588 - DNA, 324 bp, Homo sapiens
cagtctgccctgactcagcctcgctcagtgtccgggtctcctggacagtcagtcaccatctcctgcactggaaccagcagtgatcttggtggttataactttgtctcctggtaccaacaacacccaggcgaggcccccaaactcatgatttatgatgtcgctaagcggccctcaggggtccctgatcgcttctctggctccaagtctggcaacacggcctccctgaccatctctgggctccaggctgaggatgaggctgattattactgctcctcatatgcaggcatctgggtgttcggcggagggaccaagctgaccgtccta

SEQ ID NO: 2589 - DNA, 384 bp, Homo sapiens
cgggtccagttggtacagtctggggctgaggtgaggaagcctggggcctcagtgagggtctcctgcaaggtgtccgggtactccctcagtgaattatccatgcactgggtgcgacaggctcctggaaaagggcttgagtggatgggaggctttgatcctgaagatggtgaaacagtctacgcacagaggttccaaggcagagtctccatgaccgaggacatatctacagacacagcccacatggagctgagcagcctgagatctgacgacacggccgtctattactgtgcatccgggggtctcaacggtgactacgtcacgggtggggcctactactattacatggacgtctggggcaaggggaccacggtcaccgtctcctca

SEQ ID NO: 2590 - DNA, 336 bp, Homo sapiens
gatattgtgatgactcagtctccactctccctgcccgtcacccctggagagccggcctccatctcctgcaggtctagtcagagtctcctgcatagtaatggatacaactacttggattggtatctgcagaagccagggcagtctccacaactcctgttctatttgggttctaatcgggcctccggggtccctgacaggttcagtggcagtggatcaggcacagattttacactgaaaatcagcagagtggaggctgaggatgttggggtttattactgcatgcaagctctacaaactcctcggacattcggccaagggacacgactggaaattaaa

SEQ ID NO: 2591 - DNA, 375 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacgtatgcccaggacttcacaggacggtttgtcttctccttggacacctctgtcagcacggcatatctgcacatcagcagcctaaaggctgaggacactgccgtgtattactgtgcgagagatcaggacactaagtacccaacttactactactactacatggacgtctggggcaaagggaccacggtcaccgtctcctca

SEQ ID NO: 2592 - DNA, 336 bp, Homo sapiens
gatattgtgatgacccagactccactctctctgtccgtcacccctggacagccggcctccatctcctgcaagtctagtcagagcctcctgcatggtgatggaaagacctatttgtattggtacctgcagaagccaggccagtctccacagctcctgatctatgaagtttccaaccggttctctggagtgccagataggttcagtggcagcgggtcagggacagatttcacactgaaaatcagccgggtggaggctgaggatgttgggatttattactgcatgcaaagtattcagcttcctctcactttcggcggagggaccaaggtggacatcaaa

SEQ ID NO: 2593 - DNA, 366 bp, Homo sapiens
caggtgcagctgcaggagtcgggcccaggactggtgaagccttcacagaccctgtccctcacctgctctgtctctggtgcctccatcagcagtggtagtcactactggagctgggtccggcagcccgccggcaagggactggagtggattgggcgtatctacaccagtgggaacagtaactacaacccctccctcaagagtcgaataatcatgtcagtggacacgtccaaaaaccagttctccctgaagctgacctctgtgagcgccgcagacacggccgtatatttctgtgcgagagagggtcagagctactactccttctacatggacgtctggggcaaagggaccacggtcaccgtctcctca

SEQ ID NO: 2594 - DNA, 330 bp, Homo sapiens
cagtctgtgctgactcagccaccctcagcgtctgggacccccgggcagagggtcaccatcgcctgttctggaaccagctccaacatcgaaagtaatactgtgagctggtaccagcagctcccaggaacggcccccacactcctcatctatggtgataatcagcggccctcaggggtccctgaccgattctctggctccaagtctggcacctcagcctccctggccatcagtgggctccagtctgaggatgaggctgattatttctgtgcatcatgggatgacagcctgaatggtccggtgttcggcggagggaccaagctgaccgtccta

SEQ ID NO: 2595 - DNA, 387 bp, Homo sapiens
gaggtgcagctggtggagtctgggggaggcttggtacggcctggagggtccctgagactctcctgtgcagcctctggattcaccttcagtagttatgaaatgaactgggtccgccaggctccagggaaggggctggagtgggtttcatacattggtagtagtggtagtaccatatactacgcagactctgtgaagggccgattcaccatctccagagacaacgccaagaactcactgtatctgcaaatgaacagcctgagagccgaggacacggctgtttattactgtgcgagagatatagcagcagctggttcggcccgtagaggatactactactacttctacatggacgtctggggcaaagggaccacggtcaccgtctcctca

SEQ ID NO: 2596 - DNA, 327 bp, Homo sapiens
gaaattgtgttgacacagtctccagccaccctgtctttgtctccaggggaaagagccaccctctcctgcagggccagtcagagtgttagcagcaacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccgaggtacacttttggccaggggaccaagctggagatcaaa

SEQ ID NO: 2597 - DNA, 384 bp, Homo sapiens
gaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagtccgtccttccaaggccaggtcaccatctcagccgacaagtccatcagcaccgcctacctgcagtggagcagcctgaaggcctcggacaccgccatgtattactgtgcgagacccatttttagcggatattgtaatagttttagctgctatattggatacttccaacactggggccagggcaccctggtcaccgtctcctca

SEQ ID NO: 2598 - DNA, 333 bp, Homo sapiens
aattttatgctgactcagccccactctgtgtcggagtctccggggaagacggtaaccatctcctgcacccgcagcagtggcagcattgccagcaactatgtgcagtggtaccagcagcgcccgggcagtgtccccaccactgtgatctatgaggataaccaaagaccgtctggggtccctgatcggttctctggctccatcgacagctcctccaactctgcctccctcaccatctctggactgaagactgaggacgaggctgactactactgtcagtcttatgatagcagcaatcgtggggtgttcggcggagggaccaagctgaccgtccta

SEQ ID NO: 2599 - DNA, 366 bp, Homo sapiens
caggtgcagctggtgcagtctggggctgaggtgaagaagcctgggtcctcggtgaaggtctcctgcaaggcttctggaggcaccttcagcagctatgctatcacctgggtgcgacaggcccctggacaagggcttgagtggatgggagggatcatccctatctttggtacagcaaactacgcacagaagttccagggcagagtcacgattaccgcggacgaatccacgagcacaacctacatggagctgagcagcctgagatctgaggacacggccgtgtattactgttctaaacttggggggtatgatagtcgtggttggacctttgactactggggccagggaaccctggtcaccgtctcctca

SEQ ID NO: 2600 - DNA, 327 bp, Homo sapiens
gaaattgtgttgacacagtctccagccaccctgtctttgtctccaggggaaagagccaccctctcctgcagggccagtcagagtgttagcagctacttagcctggtaccaacagaagcctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtcgcaactggcctccggctctcactttcggcggagggaccaaggtggagatcaaa

SEQ ID NO: 2601 - DNA, 372 bp, Homo sapiens
cagatcaccttgcaggagtctggtcctacgctggtgaaacccacacagaccctcacgctgacctgcgccttctctgggttctctctcagcactaatggggtgcgtgtgggctggatccgtcagcccccaggaaaggccctggagtggcttgcaatcgtctcttgggataataacgaccactacaacccgtctctgaggaacagactcaccctcaccagggacacctccaaaagccagatagtccttacaatgaccaacatggaccctgtggacacaggcacttattactgtgcacacagacgtgcgtttagtagtgagtggtatgactggttccacccctggggccagggaaccctggtcaccgtctcctca

SEQ ID NO: 2602 - DNA, 321 bp, Homo sapiens
gaaattgttttgacacagtctccagccaccctgtctttgtctccaggggaaagggtcgccctctcctgcagggccagtcagaatattgagaacactttaggctggtaccaacagaaacctggccaggctcccaggctcctcatctctgatgcatctacccgggccactggcacccccgccaggttcactggcagtgggtctgggacagacttcactctcagcatcagcagcctagagcctgaagattttgcagtttattattgtcagcagcgatacaggtggcctctcactttcggcggagggaccaaggtggaggtcaga

SEQ ID NO: 2603 - DNA, 357 bp, Homo sapiens
cagatcaccttgaaggagtctgggcctccgctggtggaacccaaacagaccctcaggctgacctgcaccttctctgggttctcactcacaactaatggagaggctgtgggctggatccgtcagccccccggaaaggccctggagtggctcgcactcatttattgggatgatgataagcgctacagcccatctctgaggaacagactcaccatcaccagggacacctccaaaaaccaggttgtccttacaatgaccaacgtggaccctgtggacacagccacatattactgtgcacacagggcagttatcttaaactttgatcactggggccagggacttctggtcaccgtctcctca

SEQ ID NO: 2604 - DNA, 321 bp, Homo sapiens
ttctatgagctgactcagccaccctcagtgtccgtgtccccaggacagacagccggcatcacctgctctggagataaattgggacataaatatgcttattggtatcaacagaagccaggccagtcccctatactgctcatctatcaggatggcaagcggccctcagggatccctgagcgattctctggctccaactctgggactatagccactctgaccatcagcgggacccagcctgtggatgaggctgactattactgtcaggcgtgggacaacgacgctggggtggtgttcggcggagggaccaagctgaccgtcctt

SEQ ID NO: 2605 - DNA, 375 bp, Homo sapiens
caggtgcagctggtgcaatctgggtctgagttgaagaagccgggggcctcagtgaaggtttcctgcaaggcttctggatacaccttcaccacctatgctatcaattgggtgcgacaggcccctggacaagggcttgagtggatgggatggatcaacaccaacactgggaacccaacatatgcccaggacttcacaggacggtttgtcttctccttggacacctctgtcagcacggcatatctgcagatcagcagcctaaagactgaggacactgccgtgtattactgtgcgagagatgggatgatagtagtgcctcaatattactactactacatggacgtctggggcaaagggaccacggtcaccgtctcctca

SEQ ID NO: 2606 - DNA, 336 bp, Homo sapiens
gatattgtgatgacccagactccactctctctgtccgtcacccctggacagccggcctccatctcctgcaagtctagtcagaacctcctgcatagtgacggaaagacctatttgtattggtacctgcagaagccaggccagtctccacagctcctgatctatgaactttccgaccggttctctggagtgccagataggttcagtggcagcgggtcagggacagatttcacactgaaaatcagccgggtggaggctgaggatgttggggtttattactgcatgcaaagtatacagcttccgatcaccttcggccaagggacacgactggaaattaaa

SEQ ID NO: 2607 - DNA, 366 bp, Homo sapiens
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggccgtgtattactgtgccaaaagggggaaggggggagccgatcccttttttgactactggggccagggaaccctggtcaccgtctcctca

SEQ ID NO: 2608 - DNA, 333 bp, Homo sapiens
cagtctgtgttgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgccagcagcctgagtggtgtggtattcggcggagggaccaagctgaccgtccta

SEQ ID NO: 2609 - DNA, 363 bp, Homo sapiens
caggtgcagctggtggagtctgggggaggcgtggtccagcctgggaggtccctgagactctcctgtgcagcctctggattcaccttcaatagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgagaacttcaagtgggaactaccggggggggttcgacccctggggccagggaaccctggtcaccgtctcctca

SEQ ID NO: 2610 - DNA, 318 bp, Homo sapiens
gacatccagatgacccagtctccttccaccctgtctgcatctgtaggagacagagtcaccatcacttgccgggccagtcagactattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttactggacgttcggccaagggaccaaggtggaaatcaaa

SEQ ID NO: 2611 - DNA, 369 bp, Homo sapiens
caggtccagctggtacagtctggggctgaggtgaagaagcctggggcctcagtgaaggtctcctgcaaggtttccggatacaccctcagtgaattatccatacactgggtgcgacaggctcctggaaaagggcttgagtggatgggaggttttgatcctgaagatgttgaaacaatctacgcacagaggttccagggcagagtcaccatgaccgaggacacatctacagacacagcctacatggaattgagcagcctgagatctgacgacacggccgtgtattactgtgcaacagccccagcgactacggtggtagcgggtcactggttcgacccctggggccagggaaccctggtcaccgtctcctca

SEQ ID NO: 2612 - DNA, 333 bp, Homo sapiens
cagtctgtgctgactcagccaccctcagcgtctgggacccccgggcagagggtcaccatctcttgttctggaagcagctccaacatcgggagtaatactgtaaactggtaccagcagctcccaggaacggcccccaacctcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcgttgggtgttcggcggagggaccaagctgaccgtccta

SEQ ID NO: 2613 - DNA, 360 bp, Homo sapiens
caggtgcagctggtggagtctgggggaggcgtggtccagcctgggaggtccctgagactctcctgtgcaggctctggattcaccttcagtagctatgccatgcactgggtccgccaggctccaggcaaggggctggagtgggtggcacttatttcatatgatggaagtaataaatactatgcaaactccgtgatgggcctattcaccatctccagagacaattccaagaacacgctgtatctgcaaatgaacaccctgacagctgaggacacggctgtgtattactgtgcgaaaggtttcgctgggagctactggtacttcgatctctggggccgtggcaccctggtcactgtctcctca

SEQ ID NO: 2614 - DNA, 318 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggtagtgggtctgggacagacttcactctcaccatcagcagcctagagcctgaagattttgcagtttattactgtcagcagcgtagcagctggctcactttcggcggagggaccaaggtggagatcaaa

SEQ ID NO: 2615 - DNA, 363 bp, Homo sapiens
caggtccagctggtacagtctggggctgaggtgaagaagcctggggcctcagtgaaggtctcctgcaaggtttccggatacaccctcattgaattatccatacactgggtgcgacaggctcctggaaaagggcttgagtggatgggaggttttgaccctgaagatggtgaaacaatctacgcacagaagtttcagggcagagtcaccatgaccgaggacacatctacagacacagcctacatggagctgagcagcctgagatctgaggacacggccgtatattattgtgcaacaacactggcgatgtaccgggtgaactggttcgacccctggggccagggaacccaggtcaccgtctcctca

SEQ ID NO: 2616 - DNA, 336 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcaactcatatacaaacagcagcacccccgtttatgtcttcggaactgggaccaaggtcaccgtccta

SEQ ID NO: 2617 - DNA, 348 bp, Homo sapiens
caggtgcagctggtggagtctgggggaggcgtggtccagcctgggaggtccctgagactctcctgtgcagcgtctggattcaccttcaataactatggcatgcactgggtccgccaggctccaggcaaggggctggagtgggtggcagttatatggtatgatggaagtagtgaacactatgcagactccgtgaagggccgattcaccatctccagagacaattccaagaacacgttgtatctgcaaatgaacagcctgagagccgaggacacggctgtgtattattgtgcgagaggaccgtattccggggacgtctggggccaagggaccacggtcactgtctcctca

SEQ ID NO: 2618 - DNA, 330 bp, Homo sapiens
cagtctgtgctgactcagccaccctcagcgtctggggcccccggacagagggtcaccatctcttgttctggaagcagctccaacatcggaagtaatactgtaaactggtaccaacatctcccaggaacggcccccaaactcctcatctatagtaataataagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtccta

SEQ ID NO: 2619 - DNA, 375 bp, Homo sapiens
caggagcaactggtgcaatctgggtctgagttgaagaagcctggggcctcagtgaagatttcctgcaaggcctcgggatacaccttcattaaatttgctatgaattgggtgcgacaggcccctggacaagggcttgagtggatgggatggatcaacaccaacactgggaacccaacgttagcccagggcttcacaggacggtttgtcttctccttggacacctctcttaacacgacatatctgcagatcaatagtctaaagtctgaagacactgccgtgtatttctgtgcgaggaccgccttatatagtaagaggcacctcacatacaactatttggccccctggggccaaggaaccctggtcaccgtctcctca

SEQ ID NO: 2620 - DNA, 327 bp, Homo sapiens
gaaattgtgttgacgcagtctccaggcaccctgtctttgtctccaggggaaagagccaccctctcctgcagggccagtcagagtgttaggagcagcgacttagcctggtaccagcagagacctggccaggctcccaggctcctcatctatggtgcttccagcagggtcacaggcatctcagacaggttcagtgccagtgggtctgggacagacttcactctcaccatcagcagactggagcctgaagattttgcagtttattactgtcagcactatggtggctcacctcacctcactttcggcggagggaccaaggtggagatcaaa

SEQ ID NO: 2621 - DNA, 357 bp, Homo sapiens
gaagtgcagctggtggagtctgggggaggcttggtacagcctggcaggtccctgagactctcctgtgcagcctctggattcacctttgatgattatgccatgcactgggtccggcaagctccagggaagggcctggagtgggtctccggtattagttggaatagtggtagcataggctatgcggactctgtgaagggccgattcaccatctccagagacaacgccaagaactccctgtatctgcaaatgaccagtctgagggctgaggacacggccttgtattactgtgcaaaagactctccgggcggtatgaagtatgcctattggggccagggaaccctggtcaccgtctcctca

SEQ ID NO: 2622 - DNA, 336 bp, Homo sapiens
gatattgtgatgacccagactccactctctctgtccgtcacccctggacagccggcctccatttcctgcaagtctagtcagagcctcctgcatagtgaaggaaagacctatttgtattggtatgtgcagaagccaggccagtctccacagctcctgatctatgaagtttccaaccggttctctggagtgccagataggttcagtggcagcgggtcagggacagatttcacactgaaaatcagccgggtggaggctgaggatgttggggtttattactgcatgcaaagtatacaggttcctcggacgttcggccaagggaccaaggtggaaatcaaa

SEQ ID NO: 2623 - DNA, 354 bp, Homo sapiens
caggtgcagctggtggagtctgggggaggcgtggtccagcctgggaggtccctgagactctcctgtgcagcctctggatctaccttcagtacctatggcatgcactgggtccgccaggctccaggcaaggggctggagtgggttgcagttgtatcatatgatggaagtaataaatactatgcagactccgtgaagggccgattcaccatctccagagacaattccaagaacacgctctatctccaagtaaatagcctgagagctgaggacacggctgtgtattactgtgcgaaagatctgtccctcggcggtatggacgtctggggccaagggaccacggtcaccgtctcctca

SEQ ID NO: 2624 - DNA, 339 bp, Homo sapiens
gacatcgtgatgacccagtctccagactccctggctgtgtctctgggcgagagggccaccatcaactgcaagtccagccagagtgttttaaacagctcccagaataagaactccttagcttggtaccagcagaaaccaggacagcctcctaagctgctcatttactgggcatctacccgggaatccggggtccctgaccgattcagtggcagcgggtctgggacagatttcaccctcaccatcagcagcctgcaggctgaagatgtggcagtttattactgtcagcaacattatagtactccattcactttcggccctgggaccaaagtgcatatcaaa

SEQ ID NO: 2625 - DNA, 366 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgtgagtagcacaacctacgcggactccgtgaagggccgattcaccatttccagagacaacgccaagaacacgctgtatctgcatatgaacagtctgagagccgaggacacggctgtgtattactgtgcaagacagggccctttttctcgctactactacggtatggacgtctggggccaagggaccacggtcaccgtctcctca

SEQ ID NO: 2626 - DNA, 330 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacttcaatcggccctcaggggtccctgaccgatactctggctccaagtctggcacctcagcctccctggccatcactgggctccaggctgaggatgaggctgattattactgccagtcctatgacaccagcctgagtgtggtatttggcggagggaccaagctgaccgtccta

SEQ ID NO: 2627 - DNA, 348 bp, Homo sapiens
gaggtgcagctgttggagtctgggggaggcttggtacagcctggggggtccctgagactctcctgtgcagcctctggattcacctttagcagctatgccatgaactgggtccgccaggctccagggaaggggctggactgggtctcaggtatcagtggtagtggtgatatcacatactacgcagactccgtgaagggccggttcaccatctccagagacaattccaagaacacactgtatctgcaaatgaacagcctgagagccggggacacggccgtatattactgtgcgaaattggataaagctggtatggcgtggggccagggaaccctggtcaccgcctcctca

SEQ ID NO: 2628 - DNA, 339 bp, Homo sapiens
gacatcgtgatgacccagtctccagactccctggctgtgtctctgggcgagagggccaccatcaactgcaagtccagccagagtgttttatacagctccaacaataagaaccagttagcttggtaccagcagaaaccaggacagcctcctaaggtgctcatttactgggcatctacccgggaatccggggtccctgaccgattcagtggcagcgggtctgggacagatttcactctcaccatcagcagcctgcaggctgaagatgtggcagtttattactgtcaccaatattatagtactccttacacttttggccaggggaccaagctggagatcaaa

SEQ ID NO: 2629 - DNA, 354 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacactgtatctgcaaatgaacagcctgagacctgaggacacggctgtgttttactgtgcgaaagaggactacgtagccggtatggacgtctggggccaagggaccgcggtcaccgtctcctca

SEQ ID NO: 2630 - DNA, 339 bp, Homo sapiens
gacatcgtgatgacccagtctccagactccctggctgtgtctctgggcgagagggccaccatcaactgcaagtccagccagagtgttttatacagctccaccaataagaaccacttagcttggtaccagcagaagccaggacagcctcctaaactgctcatttactgggcatctacccgggaatccggggtccctgaccgattcagtggcagcgggtctgggacagatttcagtctcaccatcagtagcctgcaggctgaagatgtggcagtttattactgtcagcaatattatagtattccccggacgttcggccaagggaccaaggtggaaatcaaa

SEQ ID NO: 2631 - DNA, 369 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatattatgcagactccgtgaagggccgattcaccatctccagagacaattccaagaacacgctgtatctgcaaatgaacagcctgagagccgaggacacggctgtgtattactgtgcgagagatctaatgtgggcagctggtcccggcctagatggggccgactggggccagggaaccctggtcaccgtctcctca

SEQ ID NO: 2632 - DNA, 324 bp, Homo sapiens
tcctatgagctgacacagccaccctcggtgtcagtgtccccaggacaaacggccaggatcacctgctctggagatgcattgccaaaaaaatatacttattggtaccagcagaagtcaggccaggcccctgtgctggtcatctatgaggacagcaaacgaccctccgggatccctgagagattctctggctccagctcagggacaatggccaccttgactatcagtggggcccaggtggaggatgaatctgactactactgttactcaacagacagcagtggtaatcattgggtgttcggcggagggaccaagctgaccgtccta

SEQ ID NO: 2633 - DNA, 363 bp, Homo sapiens
cagatacaactagtggagtctgggggaggcgtggtccggcccgggaggtccctgagtctctcctgtgcaggcactggattcgccctcagtaattacgctactcactgggtccgccaggctccaggcaagggcctggagtgggtggcagttatgtcattcgatggaaaaagtgaatatttcgcagactcggtgaagggccgagtcaccctctccagagacaattccaagaacacattaaatctgcaattgaacagactgagggttgacgacacggctgtgtatttctgtgcgaggagtcggggagtagtggtcaatcacggcttggacgtctggggccaaggaaccacggtcaccgtcgcctca

SEQ ID NO: 2634 - DNA, 330 bp, Homo sapiens
cagtctgagctgactcagccaccctcagcgtctgggacccccgggcagagggtcatcatctcttgttctggcggcacctccaacatcggaagtaatagtgtgcactggtaccagcagctccccggaacggcccccaaactcctcatccacagtgataatgagcggccctcaggggtccctgaccgcatctctggctcaaagtctggcacctcatcctccctggccatcagtgggctccagtctgaggatgaggctcattactactgcgcaacatgggatgacagcctgaagggttgggtgttcggcggagggaccaagctgagtgtccta

SEQ ID NO: 2635 - DNA, 375 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggttcatccctatccttgatataccaaactacgcacagaagttccagggcagagtcacgattaccgcggacaaatccacgagcacagcctacatggagctgagcagcctgagatctgaggacacggccgtgtattactgtgcgagagatcagagaaggcctggaaccgttctcacttacaactggttcgacccctggggccagggaaccctggtcaccgtctcctca

SEQ ID NO: 2636 - DNA, 333 bp, Homo sapiens
cagtctgccctgactcagcctcgctcagtgtccgggtctcctggacagtcagtcaccatctcctgcactggaaccagcagtgatgttggtggttatgactatgtctcctggtaccaacagcacccaggcaaggcccccaaactcatgatttttgatgtcagtaagcggccctcaggggtccctgatcgcttctctggctccaagtctggcaacacggcctccctgaccatctctgggctccaggctgaggatgaggctgattattactgctgctcatatgcaggcagctacactttagatgtcttcggaactgggaccaaggtcaccgtccta

SEQ ID NO: 2637 - DNA, 363 bp, Homo sapiens
caggtgcagctgcaggagtcgggcccaggactggtgaagccttcacagaccctgtccctcacctgcactgtctctggtggctccatcagcagtggtgattattactggagttggatccgccagcccccagggaagggcctggagtggattgggtacatctattacagtgggagcacctactacaacccgtccctcaagagtcgagttaccatatcagtagacacgtccaagaaccagttctccctgaagctgagctctgtgactgccgcagacacggccgtgtattactgtgccagagccccggtggtcggggatgatgcttttgatctctggggccaagggacaatggtcaccgtctcttca

SEQ ID NO: 2638 - DNA, 321 bp, Homo sapiens
tcttctgagctgactcaggaccctgctgtgtctgtggccttgggacagacagtcaggatcacatgccaaggagacagcctcagagactattatgcaaggtggtaccagcagaagccaggacaggcccctgtacttgtcatctatggtaaaaacaaccggccctcagggatcccagaccgattctctggctccagctcaggaaacacagattccttgaccatcactggggctcaggcggaagatgaggctgactattactgtaactcccgggacagcagtggtagccatctcttcggcggagggaccaagctgaccgtccta

SEQ ID NO: 2639 - DNA, 366 bp, Homo sapiens
caggtgcagctggtgcagtctggggctgaggtgaagaagcctgggtcctcggtgaaggtctcctgcaaggcttctggaggcaccttcagcacctatgctatcacctgggtgcgacaggcccctggacaagggcttgagtggatgggagggttcatccctatctttggtacagcaaactacgcacagaagttccagggcagagtcacgattaccgcggacgaatccacgagcacagcctacatggagctgagcagcctgagatctgaggacacggccgtgtatttctgtgcgggacatttacactatgatagtagtgggtatcaccatgactactggggccagggaaccctggtcaccgtctcctca

SEQ ID NO: 2640 - DNA, 327 bp, Homo sapiens
gaaattgtgttgacacagtctccagccaccctgtctttgtctccaggggaaagagccaccctctcctgcagggccagtcagagtgttagcaacttcttagcctggtaccagcagaaacctggccaggctcccaggctcctcatctatgatgcatctaacagggccactggcatcccagccaggttcagtggcagtgggtctgggacagacttcactctcaccatcagcagcctagagcctgaagattttgcagtttattactgtcagcagcgtagcaactggcctccgaggatcaccttcggccaagggacacgactggagattaaa

SEQ ID NO: 2641 - DNA, 354 bp, Homo sapiens
cagatcaccttgaaggagtctggtcccacgctggtgaaacccacacagaccctcacgctgacctgcaccttctctgggttgtcactcaccactggtagagtgggcgtggggtggatccgtcagcccccagggaaagccttgcaatggcttgcagtcacttatgggaatgatggtaagctctacagcccatctctgaagagtaggctcaccatcaccgaggatacctccaagagccatgtggtcctcacagtgaccaacgtggaccctgtcgacacaggcacctattattgtgcacatcacacgattcggggagttaaagactggggccagggaaccctggtcaccgtctcctca

SEQ ID NO: 2642 - DNA, 327 bp, Homo sapiens
tcctatgtgctgactcagccaccctcggtgtcaattgccccaggaaagacggccagtctttcctgtgggggaaacaaccttgcaaccaaaagtgtgtactggcaccagcagaagccaggccaggcccctgtgctggtcgtctatgatgacagcgaccggccctcagggatccctgagcgattttctggctccaagtctgggaccacggccaccctgaccatcagcagggtcgaagccggggatgaggccgactattattgtcaggtgtgggatagtatgagtgattctcatgtggtattcggcggagggaccaagctgaccgtccta

SEQ ID NO: 2643 - DNA, 360 bp, Homo sapiens
caggtgcacctggtgcagtctggggctgaggtgacgaagcctggggcctcagtgaaggtctcctgcaagacttctggatacaccttcaccagttatgatttcatctgggtgcggcaggcccctggaaaggggcttgagtggttaggatggatcaatactaacagtggcaccacagactacgcacagaagttccagggcagagtctccatgaccaggaacacttccacaagcacagtctacatggagttgagcggcctgagatccgacgacacggccttttatttctgtgcgagaacattcaccttcgggtatcgcgtcgctgacttctggggccagggaacccaggtcaccgtctcctca

SEQ ID NO: 2644 - DNA, 321 bp, Homo sapiens
gaaattgtgttgacgcagtctccaggcaccctgtctgtgtctccaggggaaagagccaccctctcttgcagggccagtcagactgttaccagcaattacatagcctggtaccagcagaagcctggccaggctcccaggctcctcatccatggtgcatccagccgggccactggcgtcccagacaggtttagtggcagtgggtctgggacagacttcactctcaccatcaccagactggagcctgatgattttggactgtatcattgtcagcagtatggtacctcacccacttttggccaggggaccaaggtggagatcaaa

SEQ ID NO: 2645 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcaattatatcatatgatggaagtaataaatattacgcagactccgtgaagggccgattcaccatctccagagacaattccaagaacacgctgtatctgcaaatgaacagcctgagagctgaggacacggctgtgtattactgtgcgagagcccgaggtgggagctacagggggccctttgactactggggccagggaaccctggtcaccgcctcctca

SEQ ID NO: 2646 - DNA, 318 bp, Homo sapiens
gacatccagatgacccagtctccttccaccctgtctgcatctgtaggagacagagtcaccatcacttgccgggccagtcagagtattagtagctggttggcctggtatcagcagaaacccgggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaa

SEQ ID NO: 2647 - DNA, 366 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacggcaaagtacgcacagaagttccagggcagagtcacgattaccgcggacgaatccacgagcacagcctacatggaactgagcagcctgagatctgaggacacggccgtgtattactgtgccaaatcgtattcctatgatagtagtggttattactctgatttctggggccagggaaccctggtcaccgtctcctca

SEQ ID NO: 2648 - DNA, 327 bp, Homo sapiens
gaaattgtgttgacacagtctccagccaccctgtctttgtctccaggggaaagagccaccctctcctgcagggccagtcagagtgttagcagcttcttagcctggtaccaacagaaacctggccaggctcccagtctcctcatctatgatgcatccaacagggccactggcatcccagccaggttcagtggcagtgggtctgggacagacttcactctcaccatcagcagcctagagcctgaagattttgcagtttattactgtcagcaccgtagcaactggcctccgaagctcactttcggcggagggaccaaggtggagatcaaa

SEQ ID NO: 2649 - DNA, 396 bp, Homo sapiens
gaggtgcagctggtggagtctgggggaggcttggtccagcctggggggtccctgagactctcctgtgcagcctctggattcacctttagtagctattggatgagctgggtccgccaggctccagggaaggggctggagtgggtggccaacataaaggaagatggaagtgagaaatactatgtggactctgtgaaggggcgattcaccatctccagagacaacgccaagaactcactgtatctgcaaatgaacagcctgagagccgaggacacggctgtgtattactgtgcgagatgcgtcgtgacctttacgatttttggagtggcccaaagaaagggtccctactcctactacatggacgtctggggcaaagggaccacggtcaccgtctcctca

SEQ ID NO: 2650 - DNA, 327 bp, Homo sapiens
tcttctgagctgactcaggaccctgctgtgtccgtggccttgggacagacagtcaggatcacatgccaaggagacagcctcagaagctattatgcaagctggtaccagcagaagccaggacaggcccctttacttgtcatctatggtgaaatcaaccggccctcagggatcccagaccgattctctggctccggctcaggaaacacagcttccttgaccatcactggggctcaggcggaagatgaggctgactattactgtaactcccgggacagcagtggtaaccttaattgggtgttcggcggagggaccaagttgaccgtccta

SEQ ID NO: 2651 - DNA, 357 bp, Homo sapiens
caggtcaccttgaaggagtctggtcctgcgctggtgaaacccacacagaccctcacactgacctgcaccttctctgggttctcactcaccaccagtgaaatgcgggcgagctggatccggcagcccccagggaaggccccggagtggcttgcacgcattgatggggaggatgataaattctacagtacatctctgaagaccaggctcaccatctccaaggactcctccaaaaaccaggtcgtcctaacaatgaccaacatggagcctgcggacacagccacctactactgtgcgcggggcccaatccgtgggtactttgattactggggccagggatccctggtcaccgtctcctca

SEQ ID NO: 2652 - DNA, 312 bp, Homo sapiens
gaaattgtgttgacgcagtctccagccatcttgtctttgtctccaggggaaagggccaccctctcttgcagggccagtcagactgttaccagcaccttcttggcctggtaccagcagaaacctggccaggctcccaggctcctcatccatggtgcatccaccagggccactggcatcccagacaggttcagtggcagtgggtctgggacagacttcactctcatcatcagcagactggagcctgaagattttgcagtgtattactgtcagcagtatggtgcgttcggccaagggaccaaggtggaaatcaaa

SEQ ID NO: 2653 - DNA, 378 bp, Homo sapiens
caggtgcaggtggtgcagtctggggctgagctgaagaagcctggggcctcagtgaaactatcctgcaaggcatctggatacaccttcaccaagtactatgtccactgggtgcgacaggcccctgggcaagggcttcagtggttgggcgttatcaaccctagtggtcgtggcacaagctacggacagaacttccagggcagagtcaccttgacgagggacacgtccacgaacacagtctacatggaggtgactagcctgacaagtgaggacacggccgtctattactgtgcgagaggagaaccggtcgctagaggcccctactactaccagtaccacatggacctctggggcacagggaccacggtcaccgtctcctca

SEQ ID NO: 2654 - DNA, 330 bp, Homo sapiens
cagtctgtgctgactcagccaccctcagcgtctgggacccccgggcagagagtcaccatctcttgttctggaaacaactccaacatcggaaggaatactgtaaactggtaccagcagctcccaggaacggcccccacactcctcatatttagtaatgatcagcggccctcaggggtccctgaccgattttctggctccaagtctggcacctcaggttccctggccatcagtgggctgcagactgaggatgaggctgattattattgtgcaacatgggatgacggcctgaatggcgtggttttcggcggagggaccaagctgaccgtccta

SEQ ID NO: 2655 - DNA, 378 bp, Homo sapiens
caagtgcaactggtggagtctgggggaggcttggtccagcctgggaggtccctgagagtctcctgtgtagcctctggattcagtttcagtaattttgctatggactgggtccgccaggctccaggcaaggggctggagtgggtggcagttctgtcccatgatggaagaaatagccactatgcagactccgtgaagggccgattcaccatctccagagacaactccaaaaacacgctgtttctgcaaatgaacagcctgagacctgaggacacggctgtttattactgtgcgaagaatcttcaaccatattgtgctagtaccagctgtcccgacgcttttgatgtctggggccaagggacaatggtcaccgtctcttca

SEQ ID NO: 2656 - DNA, 321 bp, Homo sapiens
gacatccagatgacccagtctccttccaccctgtctgcatctataggagacagagtcaccatcacttgccgggccagtcagagtgttagtagctggttggcctggtatcagcagagaccagggaaagcccctaagctcctgatctctaaggcgtctaatttagaaagtggggtcccatcaaggttcagcggcagtggatctcggacagaattcactctcaccatcagcagcctgcagcctggtgattttgcaacttattactgccaacagtataatctttacccgtacacttttggccaggggaccacactggagatcaaa

SEQ ID NO: 2657 - DNA, 375 bp, Homo sapiens
caggttcagttggtgcagtctggagctgaggtgaagaagcctggggcctcagtgaaggtctcctgcaaggcttctggttacaactttaccagctatggtatcagctgggtgcgacaggcccctggacaagggcttgagtggatgggagggatcagcgcttacaaagataacacaaactatgcacagaagttccagggcagagtcaccatgaccacagacacatccacgagcacagcctacatggagctgaggagcctgagatctgacgacacggccgtgtattactgtgcgagagagcgggggcctttacgatttttggagtgggggttaagtactgactactggggccagggaaccctggtcaccgtctcctca

SEQ ID NO: 2658 - DNA, 321 bp, Homo sapiens
gacatccagatgacccagtctccatcctccctgtctgcatctgtaggagacagagtcaccatcacttgccgggcgagtcagggcattaggcattatttagcctggtatcaacagagaccagggaaagttcctaagctcctgatctatgctgcatccactttgcaatcaggggtcccatctcggttcagtggcagtggatctgggacagatttcactctcaccatcagcagcctgcagcctgaagatgttgcaacttattactgtcaaaagtataacagtgcccccctcactttcggccctgggaccaaggtggatgtcaaa

SEQ ID NO: 2659 - DNA, 369 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtctctgcaaatgaacagcctgagagctgaggacacggctgtgtattactgtgcgaaagcgtgggatattgtagtggtggtagctgcgggacctgactactggggccagggaaccctggtcaccgtctcctca

SEQ ID NO: 2660 - DNA, 351 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgaggtcagtaagcggccctcaggggtttctaatcgcttctctggctccaagtctggcaacacggcctccctgacaatctctgggctccaggctgaggacgaggctgattattactgctgctcatatgcaggtagtagcaatgcaggtagtagcacttcccgtgtggtattcggcggagggaccaagctgaccgtccta

SEQ ID NO: 2661 - DNA, 357 bp, Homo sapiens
cagatcaccttgaaggagtctggtcctacgctggtgaaacccacacacaccctcacgctgacctgcaccttctctgggttctcactcagcactaatggagaggctgtgggctggatccgtcagcccccaggaaagcccctggagtggcttgcactcatttattgggatgatgataaacgctacagcccatctctgaagagcaggctcaccatcaccaggggcacccccaaaaaccaggtagttcttacaatgaccaacatggaccctgtggacacagccacatactactgtgcacacagggcagttctgttaaactttgactcctggggcccgggaaccctggtcaccgtctcttca

SEQ ID NO: 2662 - DNA, 321 bp, Homo sapiens
tcctatgagctgactcagccaccctcagtgtccgtgtccccaggacagacagccagcatcacctgctctggagataaattgggggataaatatgcttactggtatcaacagaggccaggccagtcccctttactggtcatctatcaagatcacaagcggccctcaggggtccctgaacgattctctggctccaactctgggaacacagccactctgaccatcagcgggacccaggctatggatgacgctgactattactgtcaggcgtgggacaacatcgctggggtggttttcggcggagggaccaagctgaccgtccta

SEQ ID NO: 2663 - DNA, 366 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggagcaccaactacaacccctccctcaagagtcgagtcaccatatcagtagacacgtccaagaaccagttctccctgaagctgagctctgtgaccgccgcagacacggccgtgtattactgtgcgagaggagcagcagctttatactactactacatggacgtctggggcaaagggaccacggtcaccgtctcctca

SEQ ID NO: 2664 - DNA, 318 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttccagtacccctcggttcggccaagggaccaaggtggaaatcaaa

SEQ ID NO: 2665 - DNA, 354 bp, Homo sapiens
gaggtgcagctgttggagtctgggggaggcttggtacagcctggggggtccctgagactctcctgtgcagcctctggatttagtttgacagccaatttcatgaactgggtccgccaggctccagggcaggggctggagtgggtctcaactataagtaatactggggctgtcacagactacgcagagtccgtgaagggccggttcaccatctccagagacatttccaagaacaccctgtatctgcagatgaccagcctgggagccgacgacacggccatgtattactgtgcgaaagatttacactggtacggtatggacgtctggggcccagggaccacggtcaccgtctcctca

SEQ ID NO: 2666 - DNA, 330 bp, Homo sapiens
cggtctgtgttgacgcagccgccctcagtgtctgcggccccaggacagacggtcaccatctcctgctctggaggcctcgccaacgttggggaaaattttgtatcctggtatcagcagttcccaggtacagcccccaaactcctcacttatgacaacaataggcgaccctcagggattcctgaccgattctctggctccaagtctggcacgtcagccaccctgggcatcaccggactccagactggggacgaggccgattattattgcggagcatgggatagcggcctgagggctgtggtgttcggcggagggaccaagttgaccgtcctg

SEQ ID NO: 2667 - DNA, 351 bp, Homo sapiens
caggtgcagctggtggagtctgggggaggcgtggtccagcctgggaggtccctgagactctcctgtgcagcgtctggcttcaccttcagtacctatggcatacactgggtccgccaggctccaggcaaggggctggagtgggtggcagttatatggtatgatggaagtaataaatattatgcagactccgtgaagggccgattcaccatctccagagacaattccaagaacacggtgtatctgcaaatgaacagcctgagagccgaggacacggctgtgtattactgtgcgagagatgagatggttaaccttgactactggggccagggaaccctggtcaccgtctcctca

SEQ ID NO: 2668 - DNA, 318 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacagcaaacgaccctccgggatccctgagagattctctggctccagctcagggacaatggccaccttgactatcagtggggcccaggtagaggatgaagctgactactactgttactcaacagtcagcagtggtaatcgcttcggaactgggacccaggtcaccgtccta

SEQ ID NO: 2669 - DNA, 381 bp, Homo sapiens
cagttgcagctgcaggagtcgggcccgggactggtgaagtcttcggagaccttgtcactcacgtgttctgtctctggtggctcccttatcagtaggagttactactgggcctgggtccgccagcccccagggaagggactggagtggattgccagtatcgattacagtgggagcaccttcgacaacccgtccctcaggggtcgagtcaccatatcggtagacacgtccaagaagcagttctccctgaagttgaagtctgtgaccgccgcagacacggctgtctatttctgtgcgagacagacgaaggtcggaacgccgttcggagagttcctctactactttgactactggggccagggaaccctggtccccgtctcctca

SEQ ID NO: 2670 - DNA, 324 bp, Homo sapiens
gacatccagatgacccagtctccatcctccctgtctgcatctgtgggcgacagagtcaccatcacttgccgggcgagtcagagcattaccagacatttaaattggtatcagcagaaaccagggaaagcccctaagctcctcatctatgctgcatccactttgcatactggggtcccatcaaggttcagtggcagtggatctgggacagatttcactctcaccatccacagtctacaacctgaagattttgccacttactactgtcaccagagttacaatactccccccgcgactttcggcggagggaccagggtagagatcaaa

SEQ ID NO: 2671 - DNA, 393 bp, Homo sapiens
gaggtgcagctggtggagtctgggggaggcctggtcaagccgggggggtccctgagactctcctgtgcagcctctggattcaccttcagtggatataccatgaactgggtccgccaggctccagggaaggggctggagtgggtctcatccattagtagtagtagtagttacatatactacgcagactcagtgaagggccgattcaccatctccagagacaacgccaagaactcactgtatctgcagatgaacagcctgagagtcgaggacacggctatgtattactgtgcgagagatcgtgtcaattatggggatgttttgataggacctgaggcgttatattattatggtatggacgtctggggccaagggaccacggtcaccgtctcctca

SEQ ID NO: 2672 - DNA, 333 bp, Homo sapiens
cagtctgtgttgacgcagccgccctcagtgtctgcggcctcaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctggcggggtattcggcggagggaccaagctgaccgtccta

SEQ ID NO: 2673 - DNA, 357 bp, Homo sapiens
caggtgcagctgcaggagtcgggcccaggactggtgaagccttcacagaccctgaccctcacctgcactttctctgatgactccttcatcagtggtagttactactggagctggattcggcagcccgccgggaagggactggagtggattgggcgtatccatcgtagtggaaacaccttctacaacccctccctcaggagtcgagtcaccatatcattagacaggtccaagaagcacttctccctgaacctgagctctgtgaccgccgcagacacggccgtgtattactgtgcgagagagatcggtgaaggttaccttgactcctggggccagggaaccctggtcaccgtctcctca

SEQ ID NO: 2674 - DNA, 330 bp, Homo sapiens
cagtctgtgctgactcagccaccctcagcgtctgggacccccgggcagagggtcaccatctcctgttctggaagcagctccaacatcggaagtaattatgtatactggtaccagcagctcccaggaacggcccccaaactcctcatctataggaatgttcagcggccctcaggggtttctgaccgattttctggctccaagtctggcacctcagcctccctggccgtcagtgggctccggtccgaggatgaggctgactattactgtgcgacatgggatgactacctgagtggtgtggtgttcggcggagggaccaaactgaccgtccta

SEQ ID NO: 2675 - DNA, 387 bp, Homo sapiens
gaagtgcagctggtggagtctgggggaggcttggtagagcctggcaggtccctgagactctcctgtgcagcctctggattcatctttgatgattatgccatgcactgggtccgtcaagctccagggaagggcctggagtgggtctcaggtattagttgggatagtggtagcatagcctatgcggactctgtgaagggccgattcaccatctcgagagacaacgccaagaactccctgtatctgcaaatgaacagtctgagagctgaggacacggccttgtattactgtgcaaaagataagggtttgggatattgtagtagtgccagctgctataaagaacactacatggacgtctggggccaagggaccacggtcaccgtctcctca

SEQ ID NO: 2676 - DNA, 327 bp, Homo sapiens
tcctatgtgctgactcagccaccctcggtgtcagtggccccaggaaagacggccaggattacctgtgggggaaacaacattggaagtaaaagtgtgcactggtaccagcagaagccaggccaggcccctgtcctggtcgtctatgatgatagcgaccggccctcaggggtccctgagcgattctctggctccaactctgggaacacggccaccctgaccatcagcagggtcgaagccggggatgaggccgactattactgtcaggtgtgggatagtagtagtgatcatctttatgtcttcggaactgggaccaaggtcaccgtccta

SEQ ID NO: 2677 - DNA, 351 bp, Homo sapiens
caggtgcagctggtggagtctgggggaggcgtggtccagcctgggaggtccctgagactctcctgtgcagcctctggattcaccttcagtaactatggcatgcactgggtccgccaggctccaggcaaggggctggagtgggtggcacttatatcatatgatggaagtaataaatactatgcagactccgtgaagggccgattcaccatctccagagacaattccaagaacgcgctgtatcttcaaatgaacagcctgagagctgaggacacggctgtgtattactgtgcgagaggaggtagtgacacatttgggtactggggccagggaaccctggtcaccgtctcctca

SEQ ID NO: 2678 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcgaaacatgggatagcagcctgagtggttatgtcttcggaactgggaccaaggtcaccgtccta

SEQ ID NO: 2679 - DNA, 369 bp, Homo sapiens
caggtgcagctggtggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaataaatactatgcagactccgtgaagggccgattcaccatctccagagacaagtccaagaacacgctgtatctgcaaatgaacagcctgagagctgaggacacggctgtgtattactgtgcgaaagatgcctcgattgtagtagtaccagtcggctacttccagcactggggccagggcaccctggtcaccgtctcctcc

SEQ ID NO: 2680 - DNA, 330 bp, Homo sapiens
cagtctgccctgactcagcctgcctccgtgtctgggtctcctggacagtcgatcaccatctcctgcactggaaccaccagtgacgttggtcgttatgactatgtctcctggtaccaacaacacccaggcaaagcccccaaactcatgatttatgatgtcagtaatcggccctcaggggtttctaatcgcttctctggctccaagtctggcaacacggcctccctgatcatctctgggctccaggctgaggacgaggctgattattactgcagctcatatacgagcagccgcaggagggtgttcggcggagggaccaagctgaccgtccta

SEQ ID NO: 2681 - DNA, 357 bp, Homo sapiens
gaggtgcaggtggtggagtcggggggaggcttggtccagcctggggggtccctgagactctcctgtgaagcctctggaatcacctttagcactcattggatgacctgggtccgtcaggctccagggaaggggctggagtgggtggccaacgtaggcctagatgtaagtgagagacagtatgtgggcgctgtgaggggccgattcaccatctccagagacaacgccaagaactcactatatctgcaaatggacagcctgagagtcgacgacatgggtgtatattactgtgggtcttttgtggctggtagtggtcgggttgactactggggccagggatccctggtcatcgtctcctca

SEQ ID NO: 2682 - DNA, 324 bp, Homo sapiens
gacgtccagatgacccagtctccttccaccctgtctgcatctgtgggagacagagtcaccatcacttgccgggccagtcagattgtttatagtacctggttggcctggtatcagcagaaaccaggaaaagcccctaagctcctgatctataaggcgtctactttggcaaatggggtcccatcaaggttcagcggcagtgcatctggggcagaattcactctcgccatcagcagcctgcagcctgatgattttgcaacttattcctgccaacagtatcattatttgccgtggacgttcggccaagggaccaaggtggaaatcaaa

SEQ ID NO: 2683 - DNA, 369 bp, Homo sapiens
caggtgcagctggtgcagtctggggctgaggtgaagaagcctgggtcctcggtgaaggtctcctgcaaggcctctggaggcaccttcagcagctatgctatcagctgggtgcgacaggcccctggacaagggcttgagtggatgggaggaatcatccccatctttggtacaggaaactacgcacagaggttccagggcagagtcacgattaccgcggacgaatccacgagcacagcctacatggagctgagcagcctgagatctgaggacacggccgtgtattactgtgcgagacattattacaatgatggtagtgattattacccgattgactactggggccagggaaccctggtcaccgtctcctca

SEQ ID NO: 2684 - DNA, 327 bp, Homo sapiens
gaaattgtgttgacacagtctccagccaccctgtctttgtctccaggggaaagagccaccctctcctgcagggccagtcagagtgttagcaacttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcaccagcgtagcaactggcctccggcgctcactttcggcggagggaccaaggtggagatcaaa

SEQ ID NO: 2685 - DNA, 372 bp, Homo sapiens
gaggtgcagctgttggagtctgggggaggcttggtacagcctggggggtccctgagactctcctgtgcagcctctggattcacctttagcagctatgccatgacctgggtccgccaggctccagggaaggggctggagtgggtctccgctattagtggtagtggtggtagcacatactacgcagactccgtgaagggccggttcaccatctccagagacatttccaagaacactctttatttgcaaatgaacagcctgagagccgaggacacggccgtatattactgtgcgaaattgaccaagccttattgtagtggtggtagatgctacgttgactactggggccagggaaccctggtcaccgtctcctca

SEQ ID NO: 2686 - DNA, 318 bp, Homo sapiens
gaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcccactttcggcggagggaccaaggtggagatcaaa

SEQ ID NO: 2687 - DNA, 375 bp, Homo sapiens
caggtgcagctggtggagtcggggggaggcgtggtccagcctgggaggtccctgagactctcctgtgcagcctctggattcaccttcagtagctttggcatgcactgggtccgccaggctccaggcaaggggctggagtgggtggcagttatatcatatgctggaagtgatgaatactatgtagactccgtgaagggccgattcaccatctccagagacgactccaagaacaccctgtatctgcaaatgaacagcctgagagctgaggacacggctgtgtattactgtgcgaaagatttcgggggggataatacagctatggttgagtacttctttgactactggggccagggaaccctggtcaccgtctcctca

SEQ ID NO: 2688 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagagagtggggtcccatcaaggttcagcggcagtggatctgggacagaattcactctcaccatcagcagcctgcagcctgatgattttgcaacttattactgccaacagtataatagttattctttcatgttcggccaagggaccaaggtggaaatcaaa

SEQ ID NO: 2689 - DNA, 384 bp, Homo sapiens
caggtccagttggtacagtctggggctgaagtgaagaagcctggggcctcagtgaaggtctcctgcaaggtttccggatacagcctcaccgaattaggcattcactgggtgcgacaggctcctggaaaagggcttgagtggatgggaggttttgatcctgaatatggtgagacaatctacgcacagaagttccagggcagagtcaccatgaccgaggacacatctaccgacacagcctacttggagttgagcagcctgagatctgaggacacggccatgtactactgtgcaggcgggggtctctacggtgactacgtcacgggtggggcctactactactatatggacgtctggggcagggggaccacggtcaccgtctcctca

SEQ ID NO: 2690 - DNA, 336 bp, Homo sapiens
gatattgtgatgactcagtctccactctccctgcccgtcacccctggagagccggcctctatctcctgcaggtcaagtcagagcctcctgcatagtaatggatacaactatttggattggtacgtgcagaagccagggcagtctccacagctcctgatctatttgggttctaatcgggcctccggggtccctgacaggttcagtggcagtggatcaggcacagattttacactgaaaatcagcagagtggagtctgaggatgttggggtttattggtgcatgcaagctctacaaactcctcggaccttcggccaagggacacgactggagattaaa

SEQ ID NO: 2691 - DNA, 360 bp, Homo sapiens
caggtgcagctgcaggagtcgggcccgggactggtgaagccttcacagaccatgtccctcacctgcactgtctctggtggctccttcagtactggtactttctactggaattggatccgccaacacccagggaagggcctggagtggattgggtccatacatccccatgggagtctctactacaacccgtccctcaagggtcgtgctatcatatcggaagacacgtctaggaaccagttctccctgaacctggctttggtgactgccgcggacacggccgtctattactgtgcgagaggtttagattcctacaaacttggggatctctggggccgtggcaccctggtcactgtctcctca

SEQ ID NO: 2692 - DNA, 339 bp, Homo sapiens
gacatcgtgatgacgcagtctccagactccctggctgtgtctctgggcgagagggccaccatcaactgcaagtccagccggaatattttatacagtgtcaacaatgagaactacgtaagttggtatcagcagaaaccaggacagcctcctaggctgctcattttctgggcatcacgtcgggcatccggggtccctgaccgattcactggcagcgggtctgggacagatttcactctcaccatcaccagcctgcaggctgaggatgtggcagtttactactgtcagcaaaattatgcttctccgtggacgttcggcctagggaccaaggtggaagtcaaa

SEQ ID NO: 2693 - DNA, 360 bp, Homo sapiens
gaggtgcagctggtggagtctgggggaggcttggtacagcctggagggtccctgagactctcctgtgcagcctctggattcaccttcagtagttatgaaatgaactgggtccgccaggctccagggaaggggctggagtgggtttcatacattagtaatagtggtagtaccatatactacgcagactctgtgaagggccgattcaccatctccagagacaacgccaagaactcactgtatctgcaaatgaatagcctgagagccgaggacacggctgtttattattgtgcgagagtccggataaggtactactactacatggacgtctggggcaaagggaccacggtcaccgtctcctca

SEQ ID NO: 2694 - DNA, 330 bp, Homo sapiens
cagtctgtgctgacgcagccgccctcagtgtctggggccccagggcagagggtcaccatctcctgcactgggagcagctccaacatcggggcaggttatgatgtacactggtatcagcagcttccaggaacagcccccaaactcctcatctatggtaacagcaatcggccctcaggggtccctgaccgattctctggctccaagtctggcacctcagcctccctggccatcactgggctccaggctgaggatgaggctgagtattactgccagtcctatgacgacagcctgagaggggtcttcggaactgggaccaaggtcaccgtccta

SEQ ID NO: 2695 - DNA, 372 bp, Homo sapiens
caggtccaacttgagcagtctggggctgaggtgaagaagcctggggcctcagtgaaggtttcctgcaaggcttctggatacaccttcagtagttataatgtgcagtggatacgcctggcccccggacttgggcttgagtggatgggatggatcaacgctggcaacggcaacacaaagtactcacagaaatttcagggcagagtcacccttaccagggacacatcggcgagcacagcctacatggaactgagcagcctcagatttgaagacacggctgtatattactgtgcgagagagtattacgatttttggagtggttattctccttctttcctcttctcgggccagggcaccgtggtcaccgtctcctca

SEQ ID NO: 2696 - DNA, 330 bp, Homo sapiens
cagtctgtgttgacgcagccgccctcagtgtctgcggccccaggacagaaagtcaccatctcctgctctggaaccacctccaacattgggactaattatgtgtcctggtaccagctgctcccaggaaaagcccccaatctcctcatttatgacactgataagcgacccgcagggattcctgaccgattctctggctccaagtctggcgcgtcagccaccctgggcatcaccggactccacactggggacgaggccgattattactgcgtaacatgggatagtaggctgagtgctgtgattttcggcggagggacgaagctgtccgtccta

SEQ ID NO: 2697 - DNA, 369 bp, Homo sapiens
gaagtgcagttggtggagtctgggggaggcttggtacagcctggcaggtccctgagactctcctgtgcagcctctggattcatgtttgatggttatgccatgcactgggtccggcaagctccagggaagggcctggagtgggtctcaggtattagttggaatagtggtaccataggctatgcggactctgtgaagggccgattcaccatctccagagacaacgccaagaactccctgtatctgcaaatgaacagtctgagacctgaggacacggccttgtattattgtgcaaaagatggtcggccagctgccatctacttctactacatggacgtctggggcaaagggaccccggtcaccgtctcctca

SEQ ID NO: 2698 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcccgtattcggcggagggaccaagctgaccgtccta

SEQ ID NO: 2699 - DNA, 387 bp, Homo sapiens
caggtccagcttgtgcagtctggggctgaggtgaagaagcctggggcctcagtgaaggtttcctgcaaggcttctggatacaccttcactaactatgctatgcagtgggtgcgccaggcccccggacaaaggcttgagtggatgggatggatcaacgctggcaatagtaatacaaaatattcagagaagttccagggcagagtcaccattaccagtgacacatacgcgagcacagcctacatggagctgagcagcctgagaactgaagacacggctgtgtattactgtgcgagagcgccaattcattccgcgtatagtagtggctggtaccactactactacggtatggacgtctggggccaagggaccacggtcaccgtctcctca

SEQ ID NO: 2700 - DNA, 321 bp, Homo sapiens
gacatccagatgacccagtctccatcctcactgtctgcatctgtaggaggcagagtcaccatcacctgtcgggcgagtcagggcattagtaattatttagcctggtttcagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacagtataatagttacccgatcaccttcggccaagggacacgactggagattaaa

SEQ ID NO: 2701 - DNA, 348 bp, Homo sapiens
gaggtgcagctggaggagtctgggggaggcctggtacagcctggggggtccctgagactctcctgtgcagcctctggattcatcttcagtgactacagcatgaactgggtccgccaggctccagggaaggggctggagtgggttgcattcattaatagtaacagtcgtagcatctactatgcagactctgtgaagggccgattcaccatctccagagagaacgccaagaactcactgtatctgcaaatgagcagcctgagtgacgaggacacggctctgtattactgtgcgaggtgggggaacggtatggacgtctggggccaagggaccacggtcaccgtctcctca

SEQ ID NO: 2702 - DNA, 321 bp, Homo sapiens
tcctatgagctgacacagccaccctcggtgtcagtgtccccaggacagacggccaggatcacctgctctggagatgcattgccaaagcagtttgcttattggtatcagcagaagccaggccaggcccctctactactaatatctaaagacagtgagaggccctcagggatccctgagcgattctctggctccagctcagggacagcagtcacgttgaccatcagtggagtccaggcagaagacgaggctgactattattgtcaatcagtagacagcagtggtagttatgtcttcggaactgggaccaaggtcaccgtccta

SEQ ID NO: 2703 - DNA, 366 bp, Homo sapiens
caggtgcagctgcaggagtcgggcccacgactggtgaagccttcacagaccctgtccctcacctgcactgtctctggtggctccatcagcagtggtagttactactggagctggatccggcagcccgccgggaagggactggagtggattgggcgtatctatagcagtgggagcaccaactacaacccctccctcaagagtcgagtcaccctatcagtagacacgtccaagaaccagttctccctgaaggtgacctctgtgaccgccgcagacacggccttgtattactgtgcgagaggagcagcagctttatactactactacatggacgtctggggcaaagggaccacggtcaccgtctcctca

SEQ ID NO: 2704 - DNA, 318 bp, Homo sapiens
gacatccagatgacccagtctccatcctccctgtctgcatttgtaggagacagagtcaccatcacttgccgggcaagtcagagcattagcaattatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttccagtacccctcgattcggccaagggaccaaggtggaaatcaaa

SEQ ID NO: 2705 - DNA, 393 bp, Homo sapiens
caggtgcagctgcaggagtcgggcccaggactggtgaagccttcacagaccctgtcgctctcctgcactgtctctggtgactccgtgaggagtgatacttcctcctggacctggatccggcagcccgccgggaagggactggagtggattggacaaatcgatcccagcgggagcaccaccgacaatccctccttttacagtcgagtcaccttttcagtagacaggtccaagaaccagttctcactgcatctgagttctgtgaccgccgcggacacggccatttatttttgtgcgagaaatatgcgtcgtaccaggtgttacagtattgaagactgtcggttcgtctactacatagacgtctggggcagagggaccacggtcaccgtctcctca

SEQ ID NO: 2706 - DNA, 321 bp, Homo sapiens
gacatccagatgacccagtctccatcctccctgtctgcatctgtaggagacagcgtcaccttcacttgccgggcaagtcagggcatcagcaggaatttaaattggtatcaatacaaaccagggaaagcccctattctcctgatctattctgcatccagtttgcaaagtggggtcccatcaaggttcagtggcagtggatctgagacagatttcactctcaccatcaacagtctgcaacctgaagattttgcaacttactactgtcagcagagttccagtaccccttggacgttcggccaagggaccaaggttgaagtcaaa

SEQ ID NO: 2707 - DNA, 378 bp, Homo sapiens
caggtgcagctggtgcaatctgggtctgagttgaagaagcctggggcctcagtgaaggtttcctgcaaggcttctggatacaccttcactagctatgctatgaattgggtgcgacaggcccctggacaagggcttgagtggatgggatggatcaacaccaacactgggaacccaacctatgcccagggcttcacaggacggtttgtcttctccttggacacctctgtcagcacggcatatctgcagatcagcagcctaaaggctgacgacactgccgtgtattactgtgcgagagatcatgatctcaatttccagctcgaatacttctactactacatggacgtctggggcaaagggaccacggtcaccgtctcctca

SEQ ID NO: 2708 - DNA, 336 bp, Homo sapiens
gatcttgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccaaccgcttctctggagtgccagataggttcagtggcagcgggtcagggacagatttcacactgaaaatcagccgggtggaggctgaggatgttggggtttattactgcatgcaaagtatacagcttccgctcactttcggcggagggaccaaggtggagatcaaa

SEQ ID NO: 2709 - DNA, 366 bp, Homo sapiens
caggtgcagctgcaggagtcgggcccaggactggtgaagccttcacagaccctgtccctcacctgcactgtctctggtggctccatcagcagtggtagttactactggagctggatccggcagcccgccgggaagggactggagtggattgggcgtatctataccagtgggaacaccaactatagcccctccctcaagagtcgagtcaccatatcagtagacacgtccaagaaccagttctccctgaagctgagctctgtgaccgccgcagacacggccgtgtattactgtgcgagagggccagctgcgacctactactactacatggacgtctggggcaaagggaccacggtcaccgtctcctca

SEQ ID NO: 2710 - DNA, 318 bp, Homo sapiens
gacatccagatgacccagtctccatcctccctgtctgcatctgtaggagacagagtcaccatcacttgccgggcaagtcagaccattaacaactatttaaattggtatcagcaaaaaccagggaaagcccctaaggtcctgatctatgctgcatccagtctgcaaagtggggtcccatcaaggttcagtggcagtggatctgggacagatttcactctcaccatcagcagtctgcaacctgaagattttgcaagttattactgtcaacagagttacagtaacctcactttcggcggagggaccaaggtggagatcaaa

SEQ ID NO: 2711 - DNA, 372 bp, Homo sapiens
caggtgcagctggtgcagtctggggctgaggtgaagaagcctgggtcctcggtgaaggtctcctgcaaggcttctggaggcaccgtcagcagctatgctatcacctgggtgcgacaggcccctggacaagggcttgagtggatgggagggatcatccctatctttggtacagcaaactacgcacagaagttccaggtcagagtcacgattaccgcggacgaatccacgagcacagcctacatggagctgagcagcctgagatctgaggacacggccgtctattactgtgcgaggctgtattacgattggggaacaacggtggctacgtttgctgactactggggccagggaaccctggtcaccgtctcctca

SEQ ID NO: 2712 - DNA, 327 bp, Homo sapiens
gaaattgtgttgacacagtctccagccaccctgtctttgtctccaggggaaagagccaccctctcctgcagggccagtcagagtattagcagctacttagcctggtaccaacagaaacctggccaggctcccaggctcctcatctatgatgcatccaatagggccactggcatcccagccaggttcagtggcagtgggtctgggacagacttcactctcaccatcagcagcctagagcctgaagattttgcagtttattactgtcagcagcgtagcaactggcctccggtgctcactttcggcggagggaccaaggtggagatcaaa

SEQ ID NO: 2713 - DNA, 369 bp, Homo sapiens; identical to SEQ ID NO: 2697

SEQ ID NO: 2714 - DNA, 324 bp, Homo sapiens
gaaattgtgttgacgcagtctccaggcaccctgtctttgtctccaggggaaagagccaccctctcctgcagggccagtcagagtcttagcagcagctacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccggggacgttcggccaagggaccaaggtggaaatcaaa

SEQ ID NO: 2715 - DNA, 369 bp, Homo sapiens
gaggtgcagctgttgcaatctgggggaggcttggtacagcctggggggtccctgagactctcctgtgtagcctctggattcacccttagcaactatgccatgacctgggtccgccaagctccagggaaggggctggagtgggtctcagcaatcagtactagtggtggcaacacacactatatagactccgtgaagggccggttcaccatctccagagacaattccaagcacaccgtgtctctgcaaatgaacagcctgagagccgaggacacggccgtgtattactgtgcgacaacaaactattattcggggagccctgttataacgcgagactgctggggccagggaaccctggtcaccgtctcctca

SEQ ID NO: 2716 - DNA, 321 bp, Homo sapiens
gacatccagatgacccagtctccatcctccctgtctgcatctgtgggagacagagtcaccatcacgtgccgggcaagtcagagcattggcaagtacttgagttggtatcaacacaaaccagggaaagcccctaacctcctgatctttggtgcgtccactttgtatagtggagtcccctcaaggttcagtggcggaggatctgggacagatttcactctcaccatcagcagtctgcagcctgaagattttgcggcttactattgtcaacagagctccctaagtccatacacttttggccaggggaccaagctggagatcaaa

SEQ ID NO: 2717 - DNA, 390 bp, Homo sapiens
caggtgcagctgcaggagtcgggcccaggactggtgaagccttcgcagaccctgtccctcacctgcgatgtctccggggagtccatcagaagtggtcgttacttctggggctggatccgccagcgcccagggaagggcctggagtggtgtggatacatttattacactgggaacacctactacaacccgtccctcaagagtcaaattaggatctcagcagacacgtcgaagaaccaggtctccctgaagctgttctctgtgacggccgcggacacggccgtctattactgtgcgggagtcgggatacaaacaactggttttgtcggtcacccgaaagcaggtggttttgtcgactactggggccagggagccctggtcatcgtctcctca

SEQ ID NO: 2718 - DNA, 321 bp, Homo sapiens
caaatagtgatgacgcagtctccagccaccctgtctgtgtctccgggggaaagagccaccctctcctgcagggccagtcagagtgttagcagcaacttggcctggtatcagcagaaacctggccaggctcccaggctcctcatctatggtgcatccgccggggccgctggtgtcccagccagattcagtggcagtgggtctgggacagagttcactctcaccatcagcagcctgcagtctgaggattttgcagtttatttctgtcagcagtataataagtggccctggacgttcggccaagggaccaaggtggaaatcaaa

SEQ ID NO: 2719 - DNA, 390 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggaccacctactacaacccgtccctcaagagtcgagtcaccatatccgtagacacgtccaagaaccagttctccctgaagctgagctctgtgacagccgcagacacggctgtgtattactgtgcgacactacactacgggacaacatacggcagatggtatagtttctactactacggtatggacgtctggggccaagggaccacggtcaccgtctcctca

SEQ ID NO: 2720 - DNA, 339 bp, Homo sapiens
gatattgtgatgactcagtctccactctccctgcccgtcacccctggagagccggcctccatctcctgcaggtctagtcagagcctcctccatagtaatgggaacaactatttggattggtacctgcagaagccagggcagtctccacagctcctgatctatttgggttctaatcgggcctccggggtccctgacaggtttagtggcagtggatcaggcacagattttacactgaaaatcagcagagtggaggctgaggatgttggggtttattactgcatgcaagctctacaaacttgggggtacacttttggccaggggaccaagctggagatcaaa

SEQ ID NO: 2721 - DNA, 360 bp, Homo sapiens
caggttcaactggtgcagtctggagctgaggtgaagaagcctggggcctcagtgaaggtctcctgcaaggcttctggttacacctttacgaactttggtgtcagctgggtgcggcaggcccctggacatgggcttgagtgggtggggtacatcagcgcttacactggttatacaaatcatgcacagaggttgcagggcagagtcaccatgaccacagacacatccacgagcacagcctacatggaactgaggagcctgacctttggcgacacggccctatattactgtgcgcgaaccaagggtgcggggactgaggatcttgactactggggccaggggaccctggtcaccgtctcctca

SEQ ID NO: 2722 - DNA, 318 bp, Homo sapiens
tcctatgaggtgactcagccaccctcagtgtccgtgtccccaggacagacagccaacatcacctgctctggagatggattgggggatagatatacttactggtatcaacagaagtcaggccagtcccctgtgctggtcatctatcaagattccgagcggccctcagggatccctgagcgcttctctggctccaactctgggaacacagccactctgaccatcagcgggacccaggctatggatgaggctgactattactgtcaggcgtgggacatcagcactgtggttttcggcggagggaccaagctgagcgtccta

SEQ ID NO: 2723 - DNA, 351 bp, Homo sapiens
gaggtgcagctggtggagtctgggggaggcttggtaaagcctggggggtcccttagactctcctgtgcagcctctggattcactttcactaacgcctggatgagctgggtccgccaggctccagggaaggggctgcagtgggtcggccgtattaaaagcaaaactgatggtgggacagcagactacgctgcacccgtgaaaggcagattcaccatttcaagagatgattcaaaaaacacgctgtatctgcaaatgaacagcctgaaaaccgaggacacagccgtgtattactgtaccacagatccctggttcgacccctggggccagggaaccctggtcaccgtctcctca

SEQ ID NO: 2724 - DNA, 324 bp, Homo sapiens
tcttctgagctgactcaggaccctgctgtgtctgtggccttgggacagacagtcaggatcacatgccaaggagacagcctcagaaactattatgcaagctggtaccagcagaagccaggacaggcccctctacttgtcatctctggtaacagccaccggccctcacatatcccagaccgattctctggctccagctcaggaaacacagcttccttgaccatcactggggctcaggcggtagatgaggctgactattactgtcactcccgggacagcagtggtaaccatgtactcttcggcggtgggaccaagctgaccgtccta

SEQ ID NO: 2725 - DNA, 357 bp, Homo sapiens
caggtgcagctgcaggagtcgggcccaggtctggtgaagccttcacagaccctgtccctcacctgcgctgtctctggtgcctccatcagcagtggtaattacttctggacttggatccgccagcccccagggaagggcctggagtggattgggtacatctattacactgggagcacctacttcaacccgtccctcaagagtcgacttaccatgtcagtggacacgtccaagaaccagttctccctgaagttgagttctgtgactgccgcagacacggccgtgtattactgtgccagagccaccaatagtggggcctacttctcctggggccagggaaccctggtcaccgtctcctca

SEQ ID NO: 2726 - DNA, 333 bp, Homo sapiens
cagtctgtgctgacgcagccgccctcagtgtctggggccccagggcagagggtcaccatctcctgcactgggaacagctccaacatcggggcaggttatgctctacactggtaccagcagcttccaggaacagcccccaaactcctcatctctgataacattgatcgcccctcaggtgtccctgaccgattctctggctccaagtcgggcacctcagcctccctggccatcaccggactccaggctgaggatgaggctgattatttctgccagtcctttgacatcgccgtgagtgcctgggtgttcggcggcgggaccaagctgaccgtccta

SEQ ID NO: 2727 - DNA, 366 bp, Homo sapiens
caggtccgactggtacagtctggggctgaggtgaagaagcctggggcctcagtgaaggtctcctgcaaggtttccggatacaccctccctgaattgtccatacactgggtgcgacaggctcctggaaaagggcttgagtggatgggaggttttgatcctgaagatggtgaagcaatctatgcacagaagttccagggcagagtcaccatgaccgaggacacatctacagacacagcctacatgaacctgagcagcctgagatctgaggacacggccgtatattactgtacaactactacggtcctcagtgggagctcctactggttcgacccctggggccagggaaccctagtcaccgtctcctca

SEQ ID NO: 2728 - DNA, 309 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcaatttattactgtcagcagcgttacacttttggccaggggaccaacctggagatcaaa

SEQ ID NO: 2729 - DNA, 393 bp, Homo sapiens
caggtgcagctggtgcagtctggggctgaggtgaagaagcctgggtcctcggtgaaggtctcctgcaaggcttctggaggcaccttcagcagttatgctatcagctgggtgcgacaggcccctggacaagggcttgagtggatgggagggatcatccctatctttggtacaccaaactacgcacagaagttgcagggcagagtcacgattaccgcggacgaatccacgagcacgattaccgcggacgaatttacgagcacagtctacatggagctgagcagcctgagatctgaggacacggccgtgtattactgtgtgacagtgttggggtatgatagtagtggtttctggattgactactggggccagggaaccctggtcaccgtctcctca

SEQ ID NO: 2730 - DNA, 327 bp, Homo sapiens
gaaattgtgttgacacagtctccagccaccctgtctttgtctccaggggaaagagccaccctctcctgcagggccagtcagagtattagcagctacttagcctggtaccaacagacacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccaaggctcactttcggcggagggaccaaggtggagatcaaa

SEQ ID NO: 2731 - DNA, 363 bp, Homo sapiens
caggtgcagctggtggagtctgggggaggcgtggtccagcctgggaggtccctgagactctcctgtgcagcctctggattcatcttcagtagctatgctatacactgggtccgccaggctccaggcaaggggctggagtgggtggcagttatatcatatgatggaagcaataaatactacgcagattccgtgaagggccgattcaccatctccagagacaattccaagaacacgctgtttctgcaaatgaacagcctgagagctgaggacacggctgtgtattactgtgcgagaggagacgtggatacagccagggtggattttgactactggggccagggaaccctggtcaccgtctcctca

SEQ ID NO: 2732 - DNA, 330 bp, Homo sapiens
cagtctgtgctgactcagccaccctcggtgtctgaagcccccaggcagagggtcaccatctcctgttctggaagcagctccaacatcggaaataatgctgtaaactggtaccagcagctcccaggaaaggctcccaaactcctcatctattatgatgatctgctgccctcaggggtctctgaccgattctctggctccaagtctggcacctcagcctccctggccatcagtgggctccagtctgaggatgaggctgattattactgtgcagcatgggatgacagcctgaatggtccggtgttcggcggagggaccaagctgaccgtccta

SEQ ID NO: 2733 - DNA, 360 bp, Homo sapiens
caggttcaactggtgcagtctggagctgaggtgaagaagcctggggcctcagtgaaggtctcctgcaaggcttctggttacacctttaccacctttggtgtcacctgggtgcggcaggcccctggacatgggcttgagtgggtgggctacatcagcgcttacactggttacacaaatcatgcacagaggttgcagggcagagtcaccttgaccacagacacatccacgagcacagcctacatggaactgaggagcctgacctttggcgacacggccctatattactgtgcgcgaaccaagggtgcggggactgaggatcttgactactggggccagggaaccctggtcaccgtctcctca

SEQ ID NO: 2734 - DNA, 318 bp, Homo sapiens
tcctatgaggtgactcagccaccctcagtgtccgtgtccccaggacagacagccaacatcacctgctctggagaaggattgggggacaggtatacttactggtatcagcagaagtcaggccagtcacccgtgttggtcatctatcaagattccgcgcggccctcagggatccctgagcgcttctctggctccagctctgggaacacagccactctgaccatcagcgggacccaggctatggatgaggctgactattactgtcaggcgtgggacatcagcactgtggttttcggcggagggaccaagctgagcgtccta

SEQ ID NO: 2735 - DNA, 384 bp, Homo sapiens
caggtgcagctggtggagtctgggggaggcgtggtccagcctgggaggtccctgagactctcctgtgcagcctctggattcaccttcagtagatatggcatgcactgggtccgccaggctccaggcaaggggctggagtgggtggcagttatatcatatgatggaagtaataaaaactatgcaggctccgtgaagggccgattcaccatctccagagacaattccaagaacacgctttatctgcaaatgaacagcctgagagctgaggacacggctgtgtattactgtgcgaaggagccacatatcggatatagccgtggctggacctactactactatggtatggacgtctggggccaagggaccacggtcaccgtctcctca

SEQ ID NO: 2736 - DNA, 336 bp, Homo sapiens
gatattgtgatgacccagactccactctctctgtccgtcacccctggacagccggcctccatctcctgcaagtctagtcagagcctcctgcatagtgatggaaagacctatttgtattggtacctgcagaagccaggccagtctccacagctcctgatctatgaagtttccaaccggttctctggagtgccagataggttcagtggcagcgggtcagggacagatttcacactgaaaatcagccgggtggaggctgcggatgttggggtttattactgcatgcaaagtatacagcttcctctcaccttcggccaggggacacgactggagattaaa

SEQ ID NO: 2737 - DNA, 387 bp, Homo sapiens
caggtgcagctgcaggagtcgggcccaggactggtgaagccttcggagaccctgtccctcacctgcactgtctctggtggctccatcagtggttactactggagctggatccggcagtccccagggaagggactggagtggattggatatatctattacagtgggagcaccgactacaatccctccctcaagagtcgagtcaccatatcagtagacacgtccaagaaccagttgtccctgaacttgagctctgtgaccgctgcggacacggccgtgtattactgtgcgagagatcaagggggggacgatttttggagtggttattttagacgctactactactacatggacgtctggggcaaagggaccacggtcaccgtctcctca

SEQ ID NO: 2738 - DNA, 321 bp, Homo sapiens
gaaattgtgttgacacagtctccagccaccctgtctttgtctccaggggaaagaggcaccctctcctgcagggccagtcagagtgttagcaaccacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttatttctgtcagcagcgtagcaactggccgctcactttcggcggagggaccaaggtggagatcaaa

SEQ ID NO: 2739 - DNA, 372 bp, Homo sapiens
caggtgcagctacagcagtggggcgcaggactgttgaagccttcggagaccctgtccctcacctgcgctgtctatggtgggtccttcagtggttactactggacctggatccgccagcccccagggaaggggctggagtggattggggaaatcaatcataatggaagcaccaactacaacccgtccctcaagagtcgagtcaccatatcagtagacacgtccaaaaaccagttctccctgaagctgagctctgtgaccgccgcggacacggctctatattactgtgcgagagcaagggggggattggttattattttctcctattactacatggacgtctggggcaaagggaccacggtcaccgtctcctca

SEQ ID NO: 2740 - DNA, 327 bp, Homo sapiens
tcttctgagctgactcaggaccctgctgtgtctgtggccttgggacagacagtcaggatcacatgccaaggagacagcctcagaacctactatccaagctggtaccagcagaagccaggacaggcccctgttcttgtcatctctgataaaaacaaccggccctcagggatcccagaccgattctctggctccagctcaggaaacacagcttccttgaccatcactggggctcaggcggaagatgaggctgactattactgtaactcccgggacagcagtggtaaccaccccgtggtattcggcggagggaccaagctgaccgtccta

SEQ ID NO: 2741 - DNA, 360 bp, Homo sapiens
caggttcagctggtgcagtctggagctgaggtgaagaagcctggggcctcagtgaaggtctcctgcaaggcttctggttacacctttaccgcctatggtatcagctgggtgcgacaggcccctggacaagggcttgagtggatgggatggatcagcgcttacaatggtgacacaaactatgcacagaaggtccaggacagagtcaccatgaccacagagacatccacgagcacagcctacatggagctgaggagcctgaaatctgacgacacggccgtgtattattgtgcgaaagggctttactatggtccgaccgcctgtgactactggggccagggaaccctggtcaccgtctcctca

SEQ ID NO: 2742 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgactttgcaacttattactgccaacactataatagttatccgtggacgttcggccaagggaccaaggtggaaatcaaa

SEQ ID NO: 2743 - DNA, 348 bp, Homo sapiens
caggtgctgctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgcttaccgcggacgaatacacagcctacatggacctgagcagtctgagatctgaggacacggccatatattactgtgcgagagatcttgtagtgggagctaccggcggatggggccagggaaccctggtcaccgtctcctca

SEQ ID NO: 2744 - DNA, 327 bp, Homo sapiens
gaaattgtgttgacacagtctccagccaccctgtctttgtctccaggggaaagagccaccctctcctgcagggccagtcagactgttagcagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtaacaactggcctccgaggctcactttcggcggagggaccaaggtggagatcaaa

SEQ ID NO: 2745 - DNA, 345 bp, Homo sapiens
caggtccagcttctgcagtctggggctgaggtggagaagcctggggcctcagtgaaggtttcctgcaaggcttctggatacaccttcactagctatgctgtgcattgggtgcgccaggcccccggacaaaggcctgagtggatgggatggatcaacgctggcaatggtaacacaaaatattcacggaggttccagggcagagtcagccttaccagtgacacatccgcgagcacagcctacatggagctgagcagcctgagatctgaagacacggctgtgtattactgtgcgagtggtagtagggttgatttctggggcccagggacaatggtcaccgtctcgtca

SEQ ID NO: 2746 - DNA, 324 bp, Homo sapiens
gaaattgtgttgacgcagtctccgggcaccctgtctttgtctccaggggagagtgccaccctctcctgcagggccagtcagagtgttagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggaacctcacctaggacgttcggccaagggaccaaggtggaaatcaaa

SEQ ID NO: 2747 - DNA, 375 bp, Homo sapiens
caggtccagcttgtgcagtctggggctgaggtgaagaagcctggggcctcagtgaaagtttcctgcaaggcctctggatatagtttcaatatgtatgctatgcattgggtgcgccaggcccccggacaaaggcttgagtggatggggtggatcaaccccggcaagaaaaacacagaattttcagagaagttccagggcagagtcaccatttccagggacacaaccgcgagcacagtttatatggagctgaggagcctgacatctgaagacacggctctatatttttgtgcaagatcgttcagtaacagtggctcttacgaggggggataccagtttgacttctggggccagggaaccctggtcaccgtctcctct

SEQ ID NO: 2748 - DNA, 321 bp, Homo sapiens
gaagtagtgatgacgcagtctccagccaccctgtctgtgtctccaggggaaggagccaccctctcctgcagggccagtcagagtattggcagcaagttagcctggtatcagcagaaacctggccaggctcccaggctcctcatctatggtgcatccaccagggccactggtatcccagccaggttcagaggcagtgagtctgggacagagttcactctcaccatcagtcgcctgcagtctgaagattttgcagtttatttctgtcaccagtataataactggccactcactttcggcggagggaccaaggtggagatcaaa

SEQ ID NO: 2749 - DNA, 342 bp, Homo sapiens
cagctgcagctgcaggagtcgggcccaggactggtgaagccttcggagaccctgtccctcacctgcactatctccagcagtagtaattactactggggctggatccgccagtccccagggaaggggctggagtggattgggagtatgttttatagtgggagcacccactacaacccgtccctcaagagtcgagtcaccatatccgtagacacgtccaagaaccagttctccctggaactgacctctgtgaccgccgcagacacggctgtctattactgtgcgagacaggaaggtggctggttcccctactggggccagggaaccctggtcaccgtctcctca

SEQ ID NO: 2750 - DNA, 327 bp, Homo sapiens
gaaattgtgttgacacagtctccagccaccctgtctctgtctccaggggaaagagccaccttctcctgcagggccagtcagagagttaggagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtggcacctggcctccggtattcactttcggccctgggaccaaagtggatatgaaa

SEQ ID NO: 2751 - protein, 123 aa, Homo sapiens
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDLPEDYGDYGYFDYWGQGTLVTVSS

SEQ ID NO: 2752 - protein, 112 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGPVVFGGGTKLTVL

SEQ ID NO: 2753 - protein, 134 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDQDYYDFWSGYFPGRGPYYYYGMDVWGQGTTVTVSS

SEQ ID NO: 2754 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPITFGQGTRLEIK

SEQ ID NO: 2755 - protein, 122 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRRGGWYSEYFQHWGQGTLVTVSS

SEQ ID NO: 2756 - protein, 111 aa, Homo sapiens
QSALTQPASVSGSPGQSITISCTGTSSDVGRYNFVSWYQQHPGTAPKLMIYDVTNRPSGISDRFSGSKSGNTASLSISGLQAEDEADYYCSSYTSTTTLEVFGTGTKVTVL

SEQ ID NO: 2757 - protein, 125 aa, Homo sapiens
EVQLVQSGAEVKKPGATVKISCKVSGYTFTDYYMHWVQQAPGKGLEWMGVVDPEDGETIYAEKFQGRVTITADTSTDTAYMELSSLRSEDTAVYYCAIPRYFDWLLSRHYGMDVWGQGTTVTVSS

SEQ ID NO: 2758 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPVTFGPGTKVDIK

SEQ ID NO: 2759 - protein, 128 aa, Homo sapiens
QVQLVQSGAEVKRPGASVKVSCKASGYTFTSYDINWVRQATGQGLEWMGWMNPYSGNTGYAQKFQGRVTMTRNTSISTAYMELSSLRSEDTAVYSCATAFTEQDIVVVVGHNGAFDIWGQGTMVTVSS

SEQ ID NO: 2760 - protein, 114 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGAYYCMQALQTPPMLTFGGGTKVEIK

SEQ ID NO: 2761 - protein, 122 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARERSLDSGLGSFDYWGQGTLVTVSS

SEQ ID NO: 2762 - protein, 110 aa, Homo sapiens; identical to SEQ ID NO: 926

SEQ ID NO: 2763 - protein, 117 aa, Homo sapiens
EVQLVESGGGLVQPGGSLRLSCAASGVTVSSNYMSWVRQAPGKGLEWVSVIYSGGSTYYADSVKGRFTISRDNSKNTLYLQMNSLRAEDTAVYYCARDSGDDAFDIWGQGTMVTVSS

SEQ ID NO: 2764 - protein, 109 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPKVTFGPGTKVDIK

SEQ ID NO: 2765 - protein, 122 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGPPFGSRYNWFDPWGQGTLVTVSS

SEQ ID NO: 2766 - protein, 111 aa, Homo sapiens; identical to SEQ ID NO: 944

SEQ ID NO: 2767 - protein, 120 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATLYSGYDLPFDYWGQGTLVTVSS

SEQ ID NO: 2768 - protein, 107 aa, Homo sapiens
AIQLTQSPSSLSASVGDRVTITCRASQGISSALAWYQQKPGKAPKLLIYDASSLESGVPSRFSGSGSGTDFTLTISSLQPEDFATYYCQQFNTYLYTFGQGTKLEIK

SEQ ID NO: 2769 - protein, 118 aa, Homo sapiens
QVHLQQWGAGLLKPSETLSRTCAVYGGSFSGYHWSWIRQPPGKGLEWIGEINHSGSPNYNPSLKSRVTLSVDTSKNQFSLKLNSVTAADTAVYYCTRLYAGMDYFDYWSQGTLVTVSS

SEQ ID NO: 2770 - protein, 107 aa, Homo sapiens
DIQMTQSPSSLSASVGDRVTVTCRASQTINSYLNWYHQKPGKAPNLLIYAASNLQSRVPSRFSGNGSGTDFTLTVTSLQPEDFGTYYCQQSYSTPYTFGQGTKLEIR

SEQ ID NO: 2771 - protein, 132 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRTEDGITIFGVVYYYYGMDVWGQGTTVTVSS

SEQ ID NO: 2772 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSPDTFGQGTKLEIK

SEQ ID NO: 2773 - protein, 122 aa, Homo sapiens
EVQLVESGGVVVQPGGSLRLSCAASGFTFDDYAMHWVRQAPGKGLEWVSLISWDGGSTYYADSVKGRFTISRDNSKNSLYLQMNSLRAEDTALYYCAKDSEQWSYYYGMDVWGQGTTVTVSS

SEQ ID NO: 2774 - protein, 107 aa, Homo sapiens
EIVLTQSPATLSLSPGERATLSCRARQSVSNYLAWYQQKPGQAPRLLIYDASNRAPGIPARFSGSGSGTDFTLTISSLEPEDFAVYYCQQRSNWPLTFGGGTKVEIK

SEQ ID NO: 2775 - protein, 123 aa, Homo sapiens
EVQLVESGGGLVQPGGSLRLSCAASGFSFSDYWMHWVRQAPGKGLVWVSRINNDGTSITYADSVKGRYNISRDNAKNTVYLQMNSLRVEDTALYYCVRGRKWEVLRGSDFDIWGQGTTVTVSS

SEQ ID NO: 2776 - protein, 108 aa, Homo sapiens
EIVLTQSAGTLSLSPGDRAALSCRASQSISSFYLAWFQQKPGQAPRLLIYGASNRATGIPDRFSGSGSGTDFTLTISSLEPEDFAVYYCQHYGISPYTFGQGTKLEIK

SEQ ID NO: 2777 - protein, 120 aa, Homo sapiens
QVQLQESGPGLVKPSGTLSLTCAVSGGSISSSNWWSWVRQFPGKGLEWIGEIYHSGRTNYNPSLKSRVTISVDKSKNQFSLKLSSVTAADTAVYYCARVGDILTGLLDYWGQGTLVTVSS

SEQ ID NO: 2778 - protein, 109 aa, Homo sapiens
SYVLTQPPSVSVAPGKTARITCGGNNIGSKNVHWYQQKPGQAPVLVIYYDSDRPSGIPERFSGSNSGNTATLTISRVEAGDEADYYCQVWDSSSDHFYVFGTGTKVTVL

SEQ ID NO: 2779 - protein, 121 aa, Homo sapiens
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCAREERFLEWFLSPWGQGTLVTVSS

SEQ ID NO: 2780 - protein, 110 aa, Homo sapiens; identical to SEQ ID NO: 806

SEQ ID NO: 2781 - protein, 117 aa, Homo sapiens
QVQLVESGGGVVQPGRSLRLSCAASGFTFSSYAMHWVRQAPGKGLEWVALISYDGSNKYYADSVKGRFTISRDNSKNTLYLQMNSLRAEDTAVYYCARDTGGGMDVWGQGTTVTVSS

SEQ ID NO: 2782 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSIVVFGGGTKLTVL

SEQ ID NO: 2783 - protein, 122 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDRPGDYVWGYFDLWGRGTLVTVSS

SEQ ID NO: 2784 - protein, 109 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYSVVFGGGTKLTVL

SEQ ID NO: 2785 - protein, 129 aa, Homo sapiens
EVQLVESGGGLVQPGGSLRLSCAASGFTFSSYDMHWVRQATGKGLEWVSAIGSAGDTYYPGSVKGRFTISRENAKNSLYLQMNSLRAGDTAVYYCARGDIVATIPGDLRYYYYYGMDVWGQGTTVTVSS

SEQ ID NO: 2786 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPYTFGQGTKLEIK

SEQ ID NO: 2787 - protein, 127 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDRLYDYIWGSYRIFDYWGQGTLVTVSS

SEQ ID NO: 2788 - protein, 108 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQKYNSAPPFTFGPGTKVDIK

SEQ ID NO: 2789 - protein, 127 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVEVTTGVDDYYYYYGMDVWGQGTTVTVSS

SEQ ID NO: 2790 - protein, 108 aa, Homo sapiens; identical to SEQ ID NO: 758

SEQ ID NO: 2791 - protein, 126 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCAREGSNMVRGVINWYFDLWGRGTLVTVSS

SEQ ID NO: 2792 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSAPRTFGQGTKVEIK

SEQ ID NO: 2793 - protein, 118 aa, Homo sapiens
QITLKESGPTLVKPTETLTLTCTFSGFSVTRTGEAAGWIRQAPGRALEWVTVIFWDDDKRYSPSLKNRLTVTKDSSKHQVVLTMTNVDPVDAATYFCWVMGGPGKEYFGQGSLVAVSS

SEQ ID NO: 2794 - protein, 112 aa, Homo sapiens
QSVLTQPPSVSGAPGQRVTVSCTGTSSSIGPYSDVHWYQHVSGKAPRLLIFGTSNRPSGVPDRFSGSKSGTSASLVIAGLRAEDEADYYCQSYDSSLGEIYVFGTGTTVTVL

SEQ ID NO: 2795 - protein, 122 aa, Homo sapiens; identical to SEQ ID NO: 1045

SEQ ID NO: 2796 - protein, 108 aa, Homo sapiens
SYVLTQPPSVSVAPGKTARITCGGNNIGSKSVHWYQQKPGQAPVLVIYYDSARPSGIPERFSGSNSGNTATLTISRVEAGDEADYYCQVWDSSSDPVVFGGGTKLTVL

SEQ ID NO: 2797 - protein, 121 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCAGVAGLYYYYGMDVWGQGTTVTVSS

SEQ ID NO: 2798 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGGGTKLTVL

SEQ ID NO: 2799 - protein, 125 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGEVVTTLNYYYYGMDVWGQGTTVTVSS

SEQ ID NO: 2800 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSTSTWVFGGGTKLTVL

SEQ ID NO: 2801 - protein, 125 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASSHGDYVVGSYYYGMDVWGQGTTVTVSS

SEQ ID NO: 2802 - protein, 107 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPPTFGQGTKVEIK

SEQ ID NO: 2803 - protein, 126 aa, Homo sapiens
EVQLVESGGHLIQPGGSLRLSCAASGFTVSSNYMNWVRQAPGKGLEWVSVIYSGGSTYYADSVKGRFTISRDNSKNTLYLQMNSLRAEDTAVYYCASRAYCGGEVWGCYYYGMDVWGQGTTVTVSS

SEQ ID NO: 2804 - protein, 106 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTLTFGGGTKVEIK

SEQ ID NO: 2805 - protein, 125 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARSYIIRSYDFWSGPRLDIWGQGTMVTVSS

SEQ ID NO: 2806 - protein, 107 aa, Homo sapiens
DIQMTQSPSSLSASVGDRVTITCQASHDISNYLNWYQQKPGKAPKLLIYDASNLETGVPSRFSGSGSGTDFTFTISSLQPEDIATYYCQQYDNLLLTFGQGTRLEIK

SEQ ID NO: 2807 - protein, 120 aa, Homo sapiens
QVQLVESGGGVVQPGRSLRLSCAASGFTFRSYVMYWVRQAPGKGLEWVAIISYDGSNKYYADSVKGRFTISRDNSKDTLYLQMSSLIAEDTAVYYCARATTVVLGYFDLWGRGTLVTVSS

SEQ ID NO: 2808 - protein, 110 aa, Homo sapiens
QSVLTQPPSVSGAPGQRVTISCTGSSSNIGAGYDVHWYQQLPGTAPKLLIYGNNNRPSGVPDRFSGSKSGTSASLAIIGLQAEDEADYYCQSYDSSLSVVFGGGTKLTVL

SEQ ID NO: 2809 - protein, 131 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATALSVVQGVTTARDYYYYYGMDVWGQGTTVTVSS

SEQ ID NO: 2810 - protein, 112 aa, Homo sapiens; identical to SEQ ID NO: 780

SEQ ID NO: 2811 - protein, 121 aa, Homo sapiens
EVSLLQSGGGLVQPGGSLRLSCAAAGFTFNTNIGMTWVRQAPGKGPEWVSTISGVYTYYADFVKGRFTISRDSSTNTLYLQMNSLRGEDTAVYYCATFARPSLSRRWFDPWGPGTLVIVSS

SEQ ID NO: 2812 - protein, 107 aa, Homo sapiens
DIQMTQSPSSVSASVGDRVTITCRASQDIATWLAWYQQKPGKAPKLLIYAASSLHSGVPSRFSGSGSGTDFTLTINSLQPEDFATYYCQQANGFPLIFGGGTKVEIK

SEQ ID NO: 2813 - protein, 123 aa, Homo sapiens
QLQLQESGPGLVKPSETLSLTCTVSGGSISSSSYYWGWIRQPPGKGLEWIGSLYYSGSTYYNPSLKSRVTISADTSKNQFSLNLSSVTAADTALYYCARHGISSWFRTPFDYWGQGTLVTVSS

SEQ ID NO: 2814 - protein, 108 aa, Homo sapiens
EIVLTQSPGTLSLSPGERATLSCRASQSVSSSFLAWYQQKPGQAPRLLIYGASSRATGIPDRFSGSGSGTDFTLTISRLEPEDFAVYYCQQYESSPRTFGQGTKVEIK

SEQ ID NO: 2815 - protein, 129 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARRADILTGYYGDSYYYGMDVWGQGTTVTVSS

SEQ ID NO: 2816 - protein, 107 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPITFGQGTRLEIK

SEQ ID NO: 2817 - protein, 128 aa, Homo sapiens
QVQLVESGGGVVQPGRSLRLSCAASGFTFTSYHMHWVRQAPGKGLEWVAAISSDGSKKYYAASVKGRLTISRDNSKNTLYVEMNRLTADDTALYFCARFRPSPKLYSTGWDNYYFDYWGQGILVTVSS

SEQ ID NO: 2818 - protein, 110 aa, Homo sapiens
QSVLTQPPSASGTPGQRVAISCSGSSSNIGSTAVNWYQQLPGTAPILLIYSDNQRPSGVPDRFSGSKSGTSASLAISGLQSEDEADYYCAAWDVSLNGVLFGGGTKVTVL

SEQ ID NO: 2819 - protein, 121 aa, Homo sapiens
QVQLVESGGGVVQPGRSLRLSCAASGFTFSSYAMHWVRQAPGKGLEWVALISNDGSNKYYADSVKGRFTISRDNSKNTLYLQMNSLRAEGTAIYYCAREGLEAAAPPFDYWGQGTLVTVSS

SEQ ID NO: 2820 - protein, 107 aa, Homo sapiens
SYELTQPPSVSVSPGQTATITCSGDKLGEKYASWYQQKPGQSPVVVIYQDRKRPSGIPERFSGSNSGNTATLTISGTQAMDEADYYCQAWDSSNSVVFGGGTKLTVP

SEQ ID NO: 2821 - protein, 128 aa, Homo sapiens
EVQLVESGGGLVQPGGSLRLSCAASGFTFSSYWMHWVRQAPGKGLVWVSRINSDGSSTSYADSVKGRFTISRDNAKNTLYLQMNSLRAEDTAVYYCARDLREYDYIWGSYRPLGMDVWGQGTTVTVSS

SEQ ID NO: 2822 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYYTFGQGTKLEIK

SEQ ID NO: 2823 - protein, 119 aa, Homo sapiens
QVQLVDSGGGVVQPGRSLRLSSAASGFAFSTYPMHWVRQAPGKGLEWVAVISYDGSNVYYADSVKGRFTISRDNSKNTLFLQMSTLRAEDTAVYYCARDSGDNSGPDYWGQGTLVTVSS

SEQ ID NO: 2824 - protein, 108 aa, Homo sapiens
SSELTQDPAVSVALGQTVRITCQGDSLRSYFPSWYQQKPGQAPVRVIYGKNNRPSGIPDRFSGSSSGNTASLTITGAQAEDEADYYCLSWDSSGTHVVFGGGTKLTVL

SEQ ID NO: 2825 - protein, 125 aa, Homo sapiens
EVQLVESGGGLLQPGRSLRLSCAASGFTFDDYAMHWVRQVPGKGPEWVSGITWNGGTIGYADSVKGRFSISRDNAKKSLYLQMNSLRAEDTALYYCAKDMGPRDFWSELGGMDVWGQGTTVTVSS

SEQ ID NO: 2826 - protein, 108 aa, Homo sapiens
EIVLTQSPGTLSLSPGKRATLSCRASQSVSSNYLAWYQQKPGQAPRLLIYGASSRATGIPDRFSGSGSGTDFTLTINRLEPEDFAVYYCQQYGRSPDTFGQGTKLEIK

SEQ ID NO: 2827 - protein, 121 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARGWGSGTYYAFDIWGQGTMVTVSS

SEQ ID NO: 2828 - protein, 110 aa, Homo sapiens; identical to SEQ ID NO: 930

SEQ ID NO: 2829 - protein, 120 aa, Homo sapiens
QVQLQESGPRLVKPSQTLSLTCTVSGGSIISGAYYWTWIRQHPEKGLEWIGYIYYSGSTSYSPSLKSRLTISLDRSQNQFSLKLTSVTAADTAVYYCARGVAAAGASDFWGQGTLVTVSS

SEQ ID NO: 2830 - protein, 109 aa, Homo sapiens
EIVMTQSPGTLSVSPGERVTLSCRASQSVSSNLAWYQQKPGQAPRLLIFGTSTRATGIPARFSGSGSGTEFTLTISSLQSEDFAVYYCQLYTNRPPMYTFGQGTKLEIK

SEQ ID NO: 2831 - protein, 126 aa, Homo sapiens
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTSHSGFRWELLTYGMDVWGQGTTVTVSS

SEQ ID NO: 2832 - protein, 110 aa, Homo sapiens
QSVLTQPPSASGTPGQRVTISCSGSSSNIGSNTVNWYQQLPGTAPKLLIYTNNQRPSGVPDRFSGSKSGTSASLAISGLQSEDEADYYCAAWDDSLNGVVFGGGTKLTVL

SEQ ID NO: 2833 - protein, 128 aa, Homo sapiens; identical to SEQ ID NO: 1103

SEQ ID NO: 2834 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLLFTFGPGTKVDIK

SEQ ID NO: 2835 - protein, 129 aa, Homo sapiens
QITLKESGPSLVKPTQTLTLTCTFSGFSLSTRGVGVDWIRQPPGKAPEWLALIYWDDDKRYNPSLKTRLNIKRGTSRNQVVLTMTKMDPGDTATYYCAHRHCKSNTCYAAAPYDGLDLWGQGTMVTVSS

SEQ ID NO: 2836 - protein, 108 aa, Homo sapiens
SYVLTQPPSVSVAPGKTARITCAGNNIATQSVHWYQHKPGQAPVLVISYGSDRPSGIPERFSGSKSGNTATVTITRVEAGDEADYYCQVWDRSSGQVVFGSGTKVTVL

SEQ ID NO: 2837 - protein, 125 aa, Homo sapiens; identical to SEQ ID NO: 1067

SEQ ID NO: 2838 - protein, 110 aa, Homo sapiens
QSALTQPPSASGSPGQSVTVSCTGTGSDVGGYNYVSWYQQHPGKAPKLMIYEVTKRPSGVPDRFSGSKSGNTASLTVSGLQAEDEADYYCSSYAGSNIVVFGGGTKLTVL

SEQ ID NO: 2839 - protein, 121 aa, Homo sapiens
QVQLQESGPGLVKPSQTLSLTCTVSGGSISSGGYYWSWIRQHPGKGLEWIGYIYYSGSAYYNPSLKSRVIISVDTSKNQFSLRLSSVTAADTAVYYCARCIAAANWYFDLWGRGTLVTVSS

SEQ ID NO: 2840 - protein, 110 aa, Homo sapiens
QSALTQPRSVSGSPGQSVTISCTGTSSYVGGYNYVSWYQQHPGKAPKLMIYDVSKRPSGVPDRFSGSKSGNTASLTISGLQAEDEADYYCCSYAGSYSWVFGGGTKLTVL

SEQ ID NO: 2841 - protein, 122 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVGEYSGYDLFFDYWGQGTLVTVSS

SEQ ID NO: 2842 - protein, 111 aa, Homo sapiens
NFMLTQPHSVSKSPGKTVTISCTGSSGSIASNYVQWYQQRPGSAPTTVIYEDNQRPSGVPDRFSGSIDSSSNSASLTISGLKTEDEADYYCQSYDSSNQGVFGGGTKLTVL

SEQ ID NO: 2843 - protein, 126 aa, Homo sapiens; identical to SEQ ID NO: 715

SEQ ID NO: 2844 - protein, 107 aa, Homo sapiens
DIQMTQSPSSLSASVGDRITITCRASQGIGKSLAWHQQKPGRAPRSLIYGASNLQSGVPSKFSGSGSGTDFTLTISSLQPEDFATYYCQQYASYPYTFGPGTKVDVK

SEQ ID NO: 2845 - protein, 130 aa, Homo sapiens; identical to SEQ ID NO: 1137

SEQ ID NO: 2846 - protein, 111 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQKYTFGQGTKLEIK

SEQ ID NO: 2847 - protein, 131 aa, Homo sapiens
QVQLQESGPGLLKPSETLSLTCTVSGVSVSRSNYYWGWIRQPPGKGLEWIGSIYYRGSTHYNPSLRSRVTISIDTSKNQFSLRLSSVIAADTAVYYCARVTTRQRISYSHDSGDFNWFDPWGQGTLVTVSS

SEQ ID NO: 2848 - protein, 111 aa, Homo sapiens
QSVLTQPPSVSGAPGQRVTISCTGSSSNIGAGYDVHWYQQLPGTAPKLLIFANTNRPSGVPDRFSGSKSGTSASLAITGLQAEDEADYYCQSYDSSLSGYVFGTGTKVTVL

SEQ ID NO: 2849 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPHSGSYLSDLDYWGQGTLVTVSS

SEQ ID NO: 2850 - protein, 107 aa, Homo sapiens; identical to SEQ ID NO: 1294

SEQ ID NO: 2851 - protein, 121 aa, Homo sapiens
EVQLLESGGGLVQPGGSLRLSCAASGFTFSFYAMSWVRQAPGKGLEWVSLIYSDDSTTYYSDSVKGRLAIFRDNSKNTLYLQMNSLRAEDTAIYYCAKTPGGITVTHFDYWGQGTLVTVSS

SEQ ID NO: 2852 - protein, 110 aa, Homo sapiens
QSALTQPASVSGSPGQSITISCTGTSSDVGSYDLVSWYQQHPGKAPKLMIYDVIKRPSGVSSRFSGSKSANTASLTVSGLQAEDEADYYCCSYAATLGVVFGGGTKLTVL

SEQ ID NO: 2853 - protein, 121 aa, Homo sapiens
EVLVESGGGLVQPGGSLRLACAASGFTFRSYWMNWVRQAPGKGLEWVAYIKEDGSEKYYLDSVKGRFTISRDNVRNSLYLQLSSLRPEDTAVYFCSRLRSGRNWGDGYDIWGQGTMVTVSS

SEQ ID NO: 2854 - protein, 107 aa, Homo sapiens
DIQMTQSPSSLSASVGGRVTVTCRASQNINTYFNWYQQKPGKAPQLLIYAASTLQSGVPSRFSGSGSGTYFTLTISSLQPEDFATYYCQQTQSIPHTFGQGTRVEIK

SEQ ID NO: 2855 - protein, 120 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCATQQWLRGRFDPWGQGTLVTVSS

SEQ ID NO: 2856 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNHHWVFGGGTKLTVL

SEQ ID NO: 2857 - protein, 128 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMTYYDFWSGYYTGRGLDYWGQGTLVTVSS

SEQ ID NO: 2858 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPLTFGGGTKVEIK

SEQ ID NO: 2859 - protein, 122 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARALAAAGYWYFDLWGRGTLVTVSS

SEQ ID NO: 2860 - protein, 110 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYVGSYTWVFGGGTKLTVL

SEQ ID NO: 2861 - protein, 120 aa, Homo sapiens
EVQLVESGGGLVKPGGSLRLSCAASGFTFSSHSVNWVRQAPGKGLEWVSSISSSSSYISYADSVKGRFTISRDNAKNSLYLQMNSLRAEDTAVYYCARDSGIIAASFDYWGQGTLVTVSS

SEQ ID NO: 2862 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPWTFGQGTKVEIK

SEQ ID NO: 2863 - protein, 124 aa, Homo sapiens
QVQLVESGGGVVQPGGSLRLSCSASGFTFNNYGFHWVRQAPGKGLEWVAVISYEGSKKYYVDSVQGRFVISRDSSKNTLFLQMNSLRPEDTGIYYCVRARDVFWFRESRDFHYWGQGTLVTVSS

SEQ ID NO: 2864 - protein, 107 aa, Homo sapiens
DIQMTQSPSSLSASVGDRVTITCRASQDISSYLAWFQQKPGKAPKSLIYAASSLQSGVPSKFSGSGSGTDFTLTITSLQPEDFATYYCQQYNSYPLTFGGGTKVEIK

SEQ ID NO: 2865 - protein, 130 aa, Homo sapiens; identical to SEQ ID NO: 1231

SEQ ID NO: 2866 - protein, 108 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPPLTFGGGTKVEIK

SEQ ID NO: 2867 - protein, 124 aa, Homo sapiens
QVQLVESGGGVVQPGRSLRLSCAASGFTFSSYAMHWVRQAPGKGLEWVAVISYDGSNKYYADSVKGRFTISRDNSKNTLYLLMNSLRAEDTAVYYCARGIYSYDSSGYYYLDYWGQGTLVTVSS

SEQ ID NO: 2868 - protein, 107 aa, Homo sapiens
EIVLTQSPGTLSLSPGERATLSCRASQSVSSSYLAWYQQKPGRAPRLLIYGASSRATGIPDRFSGSGSGTDFTLTISRLEPEDFAVYYCQQYGSSLLFGQGTKLEIK

SEQ ID NO: 2869 - protein, 123 aa, Homo sapiens; identical to SEQ ID NO: 719

SEQ ID NO: 2870 - protein, 112 aa, Homo sapiens
QLVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGLNVVFGGGTKLTVL

SEQ ID NO: 2871 - protein, 124 aa, Homo sapiens
QVQLVESGGGVVPPGGSLSLPCAASGFTFSAYAMHWLRQAPGKGLEWVAVISYDGTVKYVADSVRGRFTISRDNSNNTLYLQMTSLRSEDTAVYYCARDLGALAAAPTVYFVHWGQGTLVTVSS

SEQ ID NO: 2872 - protein, 108 aa, Homo sapiens; identical to SEQ ID NO: 782

SEQ ID NO: 2873 - protein, 124 aa, Homo sapiens
EVQLLESGGGLVQPGGSLRLSCAASGFTFSSYAMNWVRQAPGKGLEWVSIIYSGYNGTYYTDSVKGRFTISRDNSKNTLYLQMNSLRAEDTAVYYCAKPKPVGDDYGDPYFDYWGQGTLVTVSS

SEQ ID NO: 2874 - protein, 113 aa, Homo sapiens
DIVMTQSPDSLAVSLGERATINCKSSQSVLYSSNNKNYLAWYQQKPGQPPKLLIYWASTRQSGVPDRFSGSGSGTDFTLTISSLQAEDVAVYYCQQYYITPFTFGQGTKLQIK

SEQ ID NO: 2875 - protein, 130 aa, Homo sapiens
GVQLVESGGGLVQPGRSLRLSCAASGFTFHDYAMHWVRQAPGKGLEWVSGISWNSGSIGYADSVKGRFTISRDNAKNSLYLQMNSLRAEDTALYYCAKDTFGSSSWYRGDSYYYYGMDVWGQGTTVTVSS

SEQ ID NO: 2876 - protein, 113 aa, Homo sapiens; identical to SEQ ID NO: 1232

SEQ ID NO: 2877 - protein, 117 aa, Homo sapiens
QVQLVESGGGVVQPGGSLRLSCEVSGFNFRTFAMHWVRQAPGKGLEWVAVIWDDGSNQHYGDSVKGRFAISRDDSKNTVYLQMDGLRVEDTAVYYCARDRVGYCDYWGQGTHVTVSS

SEQ ID NO: 2878 - protein, 106 aa, Homo sapiens
AVVMTQSPPTLSLSPGERATVACRANQSIGINLAWYQQRPGQAPRLLIFDVSDRATGIPARFSGSGSGTEFTLTISSLQSEDFAIYYCQQYNKWPTVGQGTRVEIR

SEQ ID NO: 2879 - protein, 125 aa, Homo sapiens; identical to SEQ ID NO: 1067

SEQ ID NO: 2880 - protein, 110 aa, Homo sapiens
QSALTQPASVSGSPGQSITISCTGTSSDVGGYKYVSWYQQYPGKAPRLMIYEVTNRPSGVSNRFSGSKSGNTASLTISGLQAEDEADYYCSSYSGSTTVVFGGGTKVTVL

SEQ ID NO: 2881 - protein, 121 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGPLHYGGNSRLDYWGQGTLVTVSS

SEQ ID NO: 2882 - protein, 110 aa, Homo sapiens
QSALTQPASVSGSPGQSITISCTGTSSDIGSYNLVSWYQQHPGKTPKLMIYEVSKRPSGVSNRFSGSKSGNTASLTISGLQAEDEADYYCFSYAGSSTYVFGTGTKVTVL

SEQ ID NO: 2883 - protein, 121 aa, Homo sapiens; identical to SEQ ID NO: 2849

SEQ ID NO: 2884 - protein, 107 aa, Homo sapiens
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPVTFGQGTKVEIK

SEQ ID NO: 2885 - protein, 127 aa, Homo sapiens
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARVPITMIVVVIPYYYGMDVWGQGTTVTVSS

SEQ ID NO: 2886 - protein, 112 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGFYVFGTGTKVTVL

SEQ ID NO: 2887 - protein, 126 aa, Homo sapiens
QVQLQESGPGLVKPSGTLSLTCAVSGGSISSSNWWSWVRQPPGKGLEWIGELYHSGSTNYNPSLKSRVTISVDKSKNQFSLKLSSVTAADTAVYYCARVGPYYYDSSGYYNYFDYWGPRTLVTVSS

SEQ ID NO: 2888 - protein, 113 aa, Homo sapiens; identical to SEQ ID NO: 1182

SEQ ID NO: 2889 - protein, 123 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKDPKSSSWHPEYFQHWGQGTLVTVSS

SEQ ID NO: 2890 - protein, 113 aa, Homo sapiens; identical to SEQ ID NO: 1182

SEQ ID NO: 2891 - protein, 119 aa, Homo sapiens
EVQLLESGGNLVQPGDSLRLSCTAFGFSFGSYAMSWVRQAPGKGLEWVSLIYSGNGKTKYADSVKGRFTISRDNSKNTLYLQMNNLRADDTAVYYCAKEYTSGWFLDYWGQGTLVTVSS

SEQ ID NO: 2892 - protein, 107 aa, Homo sapiens
DIQMTQSPSSLSASVGDRVTITCRASQDIDNSLAWYQQKPGKAPKLLIYAASTLQRGVPSRFSGSGSGTDFTLTIGSLEPEDFATYYCQQADSFPLTFGGGTKVEIK

SEQ ID NO: 2893 - protein, 127 aa, Homo sapiens
QVQLVQSGAEVKKPGSSVKVSCKASGGTFSSYGISWARQAPGQGLEWMGRIIPILGIANYAQKFQGRVTITADKSTSTAYMELSSLRSEDTAVYYCARAVYAAGDDDYYYYYGMDVWGQGTTVTVSS

SEQ ID NO: 2894 - protein, 108 aa, Homo sapiens; identical to SEQ ID NO: 1250

SEQ ID NO: 2895 - protein, 119 aa, Homo sapiens
QVRLVQSGSELRKPGASVKISCKAAGYTFGSYNMNWVRQAPGQGLEWMGWINTNTGTPTYAQGFTGRFVFSLDTSANTANLQIASLRTGDTAVYFCARDTRWLRGFDYWGQGTLVTVSS

SEQ ID NO: 2896 - protein, 112 aa, Homo sapiens
QSALTQPASVSGSPGQSITISCTGTTSDIVDYNLVSWYQRHPGEAPKLIIFEGSKRPLGLSNRFSGSTSGNTASLTISGLKAEDDGDYYCCSHGGTTSPHVVFGGGTKLTVL

SEQ ID NO: 2897 - protein, 124 aa, Homo sapiens; identical to SEQ ID NO: 767

SEQ ID NO: 2898 - protein, 107 aa, Homo sapiens
EIVMTQSPATLSVSPGERATLSCRASQSVSSNLAWYQQKPGQAPRLLISGTSTRATGIPARFSGSGSGTEFTLTISTLQSEDFTVYYCQQSNNWPPTFGHGTKVEIK

SEQ ID NO: 2899 - protein, 121 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATSPGSSRSSWFDPWGQGTLVTVSS

SEQ ID NO: 2900 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSGVVFGGGTKLTVL

SEQ ID NO: 2901 - protein, 127 aa, Homo sapiens
EVQLVESGGGLVQPGGSLRLSCAASGFTFSSYSMNWVRQAPGKGLEWVSYISSSSSTIYYADSVKGRFTISRDNAKNSLYLQMNSLRDEDTAVYYCARDGGIVVVPAAIVAYGMDVWGQGTTVTVSS

SEQ ID NO: 2902 - protein, 107 aa, Homo sapiens; identical to SEQ ID NO: 748

SEQ ID NO: 2903 - protein, 132 aa, Homo sapiens
QVQVVESGGGVVQPGRSLRLSCAASGFTFSIYTMHWVRQAPGKGLEWVALISYDGSDKYYADSVKGRFTISRDNSKNTLYLQMNSLRAEDTAMYYCARGTYYSGSGSFGPRIKKDYYGMDVWGQGTTVTVSS

SEQ ID NO: 2904 - protein, 108 aa, Homo sapiens
SYELTQPPSVSVSPGQTAKITCSGDALPKQFTYWYQQKPGQAPVLVIYTDTERPSGIPERFTGSSSGTTVTLTISGVQAEDEADYYCQSADNSGTYVVFGGGTKLTVL

SEQ ID NO: 2905 - protein, 119 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARLITMVRGVDYWGQGTLVTVSS

SEQ ID NO: 2906 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPTFGGGTKVEIK

SEQ ID NO: 2907 - protein, 118 aa, Homo sapiens
QITLKESGPTLVKPTETLTLTCTFSGFSLTRTGEAAGWIRQAPGRALEWVTVIFWDDDKRYSPSLKNRLTVTKDTSKNQVVLTMTNVDPVDTATYFCWAMGGPGNEYFGRGTLVAVSS

SEQ ID NO: 2908 - protein, 112 aa, Homo sapiens
QSVLTQPPSVSGAPGQRVTVSCTGTSSSIGPYSDVHWYQHISGRAPRLLIFGTSNRPSGVPDRFSGSKSGTSASLVIAGLQAEDEADYYCQSYDSSLGEIYVFGTGTTVTVL

SEQ ID NO: 2909 - protein, 120 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGFDSNYYYADYWGQGTLVTVSS

SEQ ID NO: 2910 - protein, 107 aa, Homo sapiens; identical to SEQ ID NO: 744

SEQ ID NO: 2911 - protein, 127 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARERGAFGGVIVGRGIFDYWGQGTLVTVSS

SEQ ID NO: 2912 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSNWLPITFGQGTRLEIK

SEQ ID NO: 2913 - protein, 130 aa, Homo sapiens; identical to SEQ ID NO: 1231

SEQ ID NO: 2914 - protein, 109 aa, Homo sapiens
QTVVTQEPSLTVSPGGTVTLTCASSTGAVTSGYYPNWFQQKPGQAPRALIYNTGDKHSWTPARFSGSLLGDKAALTLSGVQPEDEAEYYCLLYYGGHWVFGGGTKVTVL

SEQ ID NO: 2915 - protein, 131 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDRTIGEVATIFGVVIIDYYFDYWGQGTLVTVSS

SEQ ID NO: 2916 - protein, 103 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYRTFGQGTKVEIK

SEQ ID NO: 2917 - protein, 124 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDTPSDYVYYYYGMDVWGQGTTVTVSS

SEQ ID NO: 2918 - protein, 105 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTVFGGGTKLTVL

SEQ ID NO: 2919 - protein, 126 aa, Homo sapiens; identical to SEQ ID NO: 689

SEQ ID NO: 2920 - protein, 110 aa, Homo sapiens; identical to SEQ ID NO: 1044

SEQ ID NO: 2921 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCVRATRGSYYWGGDYWGQGTLVTVSS

SEQ ID NO: 2922 - protein, 108 aa, Homo sapiens; identical to SEQ ID NO: 1134

SEQ ID NO: 2923 - protein, 128 aa, Homo sapiens
QLQLQESGPGLVKPSETLSLTCTVSGGSISSSTYYWGWIRQPPGKGLEWIGNIYYSGSTYYNPSLKSRVTISVDTSKNQFSLKLSSVTAADTAVYYCASLFFEITIFGVVMGYGMDVWGQGTTVTVSS

SEQ ID NO: 2924 - protein, 108 aa, Homo sapiens
EIVLTQSPATLSLSPGERATLSCRASQSVSSYLAWYQQKRGQAPRLLIYDASNRATGIPARFSGSGSGTDFTLTINSLEPEDFAVYYCQQRSNWPRLTFGGGTKVEIK

SEQ ID NO: 2925 - protein, 124 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTTVYYCARDSESDSSGWLHYFDYWGQGTLVTVSS

SEQ ID NO: 2926 - protein, 105 aa, Homo sapiens; identical to SEQ ID NO: 694

SEQ ID NO: 2927 - protein, 125 aa, Homo sapiens; identical to SEQ ID NO: 1097

SEQ ID NO: 2928 - protein, 110 aa, Homo sapiens
QSALTQPASVSGSPGQSITFSCTGTSSDVGGYNYVSWYQQHPGKAPKVMIYDVRNRPSGVSNRFSGSKSGNTASLTISGLQAEDEADYYCSSYTSSNTYVFGTGTKVTVL

SEQ ID NO: 2929 - protein, 121 aa, Homo sapiens
QVQLVQSGAEVKKPGASVKVSCKASGYTFTSFGISWVRQAPGQGLEWMGWISVYNGHTNYAQKLQGRVTMTTDTSTSTAYMELRSLRSDDTGVYYCARHGDHAFSLGIDYWGQGTLVTVSS

SEQ ID NO: 2930 - protein, 110 aa, Homo sapiens
QSLLTQPPSASGTPGQRVTISCSGSSSNIGSNAENWYQQLPGTAPKLLIYSNNQRPSGVPDRFSGSKSDTSASLAISGLQSEDEADYYCAAWDDSLNGVVFGGGTKLTVL

SEQ ID NO: 2931 - protein, 117 aa, Homo sapiens
EVQLVESGGGLIQPGGSLRLSCVASGFTVSSNYMSWVRQAPGKGLEWVSIIYSGSTTSYADSVKGRFTISRDNSKNTLYLQMNSLRAEDTAVYYCARGPEIFFLDYWGQGTLVTVSS

SEQ ID NO: 2932 - protein, 105 aa, Homo sapiens; identical to SEQ ID NO: 694

SEQ ID NO: 2933 - protein, 125 aa, Homo sapiens; identical to SEQ ID NO: 1097

SEQ ID NO: 2934 - protein, 106 aa, Homo sapiens
SYELTQTPSVSVSPGQTASITCSGDKLGDKYACWYQQKPGQPPVLVIYQDNKRPSGIPERFSGSNSGNTATLTISGTQAMDEADYYCQAWDSSAVVFGGGTKLTVL

SEQ ID NO: 2935 - protein, 128 aa, Homo sapiens; identical to SEQ ID NO: 1103

SEQ ID NO: 2936 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVL

SEQ ID NO: 2937 - protein, 119 aa, Homo sapiens
EVHLLESGGAFVQPGGSLRLSCAASGFTFGDYAMNWVRQTPGKGLEWVSVISGRGISIYYASSVKGRFTISRDDFENTLYLQMNSLRVEDTALYYCAKGSYGDNVPDHWGQGTLVAVSP

SEQ ID NO: 2938 - protein, 107 aa, Homo sapiens; identical to SEQ ID NO: 666

SEQ ID NO: 2939 - protein, 126 aa, Homo sapiens
QVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCARDPYYGSGSYYNVLVQDYWGQGTLVTVSS

SEQ ID NO: 2940 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPRTFGQGTKVEIK

SEQ ID NO: 2941 - protein, 129 aa, Homo sapiens; identical to SEQ ID NO: 1051

SEQ ID NO: 2942 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPLTFGGGTKVEIK

SEQ ID NO: 2943 - protein, 127 aa, Homo sapiens
EVSLVESGGGLVQPGRSLRLSCTASGFTLGDYIIGWFRQAPGKGPEWVGFIRRRAYGGTTQYAPSVRGRFSISRDDSKRVGYLQLSSLRTEDTAIYYCARVIDDNSWFLGEWYFDVWGRGALVSVSS

SEQ ID NO: 2944 - protein, 110 aa, Homo sapiens
QSMLTQPPSASGTPGQRVTISCSGSRSNLGNNYVFWYQQFPGTAPKLLIYRDSRRPSGVPDRFSGSRSGSSASLAISGLRSEDEADYYCAAWDDSLSDFVFATGTKVTVL

SEQ ID NO: 2945 - protein, 124 aa, Homo sapiens
MVQLLESGGGLVQPGGSLRLSCAASGFTFSTHSLAWVRQAPGMGLEWVSAISDNAVHIHYSDSVKGRFSIARDNSKNTLYLQMNSLRAEDTAVYFCVKGTFERIIAPGGGLGAWGQGTLVTVSS

SEQ ID NO: 2946 - protein, 107 aa, Homo sapiens
DIQMTQSPSSLSASVGDRITITCRASQDISNYLAWFQQKPGKAPKSLIYGASSLQSGVPSKFSGSGSGTDFTLTISSLQPDDFATYYCQQYSVYPLTFGGGTQVEIK

SEQ ID NO: 2947 - protein, 127 aa, Homo sapiens; identical to SEQ ID NO: 2787

SEQ ID NO: 2948 - protein, 108 aa, Homo sapiens
QSVLTQPPSASGTPGQRVTISCSGSSSNIGSNAVNWYQQLPGTAPKLLIYSNYERPSGVPDRFSGSKSGTSASLAISGLQSEDEAVYYCAAWDDTRVVFGGGTKLTVL

SEQ ID NO: 2949 - protein, 121 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARTLISSGYVYFDYWGQGTLVTVSS

SEQ ID NO: 2950 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNQRVVFGGGTKLTVL

SEQ ID NO: 2951 - protein, 128 aa, Homo sapiens
EVQLVESGGGLVQPGGSLRLSCAASGFIFNDHYMDWVRQAPGKGLEWVGRTRNKANSYTTEYAASVKGRFTVSRDDSKNSLFLQMNSLQTEDTAVYYCTRVSRHVHSSVYYNRWFDYWGQGTLVTVSS

SEQ ID NO: 2952 - protein, 107 aa, Homo sapiens
DIQMTQSPSSVSASVGDRVTITCRASQGISNWLAWYQQKPGKAPKLLIYTASNLESGVPSRFSGSGSGTDFSLTISSLQPEDFATYYCQQANSFPYTFGQGTRLEIV

SEQ ID NO: 2953 - protein, 121 aa, Homo sapiens; identical to SEQ ID NO: 1073

SEQ ID NO: 2954 - protein, 110 aa, Homo sapiens; identical to SEQ ID NO: 860

SEQ ID NO: 2955 - protein, 124 aa, Homo sapiens
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARIPALWFGELSYYDYWGQGTLVTVSS

SEQ ID NO: 2956 - protein, 103 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRVTFGPGTKVDIK

SEQ ID NO: 2957 - protein, 131 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVEYYDFWSGYRYYYYYYGMDVWGQGTTVTVSS

SEQ ID NO: 2958 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTFVFGTGTKVTVL

SEQ ID NO: 2959 - protein, 128 aa, Homo sapiens
QVQLQESGPGLVKPSQTLSLTCTVSGGSISSGGYYWSWIRQHPGKGLEWIGYIDYSGSTYYNPSLKSRVINSVDTSKNQFSLKLSSVTAADTAVYYCARDPGDYYDSSGYSNDAFDIWGQGTMVTVSS

SEQ ID NO: 2960 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGGGTKVEIK

SEQ ID NO: 2961 - protein, 128 aa, Homo sapiens
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTGLVYYYASSGYYYSLDYWGQGTLVTVSS

SEQ ID NO: 2962 - protein, 111 aa, Homo sapiens
QSALTQPASVSGSPGQSITISCTGTSSDVGDYNYVSWYQQHPGKAPKLMIYEVSNRPSGVSNRFSGSKSGNTASLTISGLQAEDEADYYCSSYTSSSTLNVFGTGTKVTVL

SEQ ID NO: 2963 - protein, 122 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARAHVWFGELLYLDYWGQGTLVTVSS

SEQ ID NO: 2964 - protein, 110 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSNVVFGGGTKLTVL

SEQ ID NO: 2965 - protein, 118 aa, Homo sapiens; identical to SEQ ID NO: 675

SEQ ID NO: 2966 - protein, 108 aa, Homo sapiens
EIVLTQSPATLSLSPGERATLSCRASQSVSDYLAWYQQKPGQAPRLLIYDASNRATGIPARFSGSGSGTDFTLTISSLEPEDFAVYYCQQRGKWPAITFGQGTRLEIK

SEQ ID NO: 2967 - protein, 129 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVYCGGDCYSDDYYYYYDMDVWGQGTTVTISS

SEQ ID NO: 2968 - protein, 107 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYVFGTGTKVTVL

SEQ ID NO: 2969 - protein, 122 aa, Homo sapiens
EVQLLESGGGLVQPGGSLRLSCAASGFTFSSYAMSWVRQAPGKGLEWVSAISGSGYSTYYADSVKGRFTISRDNSKNTLYLQMNSLRAEDTAVYYCAKCLSTSGHYWYFDLWGRGTLITVSS

SEQ ID NO: 2970 - protein, 107 aa, Homo sapiens; identical to SEQ ID NO: 974

SEQ ID NO: 2971 - protein, 133 aa, Homo sapiens
QVQLVESGGGVVQPGRSLRLSCAASGFTFSSYGMHWVRQAPGRGLEWVAVIWYDGSNKYYADSVKGRFTISRDNSKNTLYLQMNSLRAEDTAVYYCARDINSLRDYIWGSYRNVYYYYGMDVWGQGTTVTVSS

SEQ ID NO: 2972 - protein, 110 aa, Homo sapiens; identical to SEQ ID NO: 946

SEQ ID NO: 2973 - protein, 129 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAREFLSPVLLWFGELYYYGMDVWGQGTTVTVSS

SEQ ID NO: 2974 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLFTFGPGTKVDIK

SEQ ID NO: 2975 - protein, 130 aa, Homo sapiens
QVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCARGATYYYGSGSYFHNLDYFDYWGQGTLVTVSS

SEQ ID NO: 2976 - protein, 107 aa, Homo sapiens; identical to SEQ ID NO: 748

SEQ ID NO: 2977 - protein, 133 aa, Homo sapiens
QVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARDLYERGYDFWSGFVNMAYYYGMDVWGQGTTVTVSS

SEQ ID NO: 2978 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSPFVFGTGTKVTVL

SEQ ID NO: 2979 - protein, 122 aa, Homo sapiens
QVQLVQSGSELKKPGASVKLSCQASGYTFTNHAMNWVRQAPGQGLEWMGWINTNTGNPTYAQGFTGRFVFSLDTSVGTAYLQISSLKAEDTAFYYCARASARPGVATNLDFWGQGTLVVVSS

SEQ ID NO: 2980 - protein, 107 aa, Homo sapiens; identical to SEQ ID NO: 936

SEQ ID NO: 2981 - protein, 122 aa, Homo sapiens
QVQLEESGGGVVQPGRSLRLSCAASGFTFSNYAMHWVRQAPGKGLEWVAAIWFDGRQKVYADSVKGRFTISRDNSKNTLYLQMNSLRVDDTAVYYCARDVEQWLVQEYFQYWGHGTLVTVSS

SEQ ID NO: 2982 - protein, 108 aa, Homo sapiens
EIVMTQSPATLSVSPGERATLSCRASQSISSNLAWYQQKPGQAPRLLIYGASTRATGIPARFSGSGSGTEFSLTISSLQSEDFAVYYCQQYNNRPPATFGQGTKLEIK

SEQ ID NO: 2983 - protein, 122 aa, Homo sapiens
QVQLVESGGGVVQPGRSLRLSCAASGFTFSTYAMHWVRQAPGKGLEWLAITSYDGSNKYYADSVKGRFIISRDNSKSTLYLQMNSLRPEDTAVYYCARDLTRWELHYFFHYWGQGTLVTVSS

SEQ ID NO: 2984 - protein, 107 aa, Homo sapiens
EIVLTQSPATLSLSPGERATLSCRASQSVSSYLAWYQQKPGQPPRLLIYDASNRATGIPARFSGSGSGTDFTLTISSLEPEDFAVYYCQHRNDWPPGFGQGTRLEIK

SEQ ID NO: 2985 - protein, 124 aa, Homo sapiens
QLQLQESGPGLVKPSETLSLTCTVSGGSISSSSYYWGWIRQPPGKGLEWIGSIYYSGITYYNPSLKSRVTISVDTSKNQFSLRLSSVTAADTAVYYCARQGRYSGSHGHSFDPWGQGTLVTVSS

SEQ ID NO: 2986 - protein, 110 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSTPVFGTGTKVTVL

SEQ ID NO: 2987 - protein, 128 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDRAYYDYIWGSYRPYGMDVWGQGTTVTVSS

SEQ ID NO: 2988 - protein, 107 aa, Homo sapiens; identical to SEQ ID NO: 2862

SEQ ID NO: 2989 - protein, 119 aa, Homo sapiens
QVQLVQSGAEVKKPGASVKVSCKASGYTFTSDDMNWVRQATGQGLEWMGWMNPYSGNTGYAQKFQGRVTMTRNTSISTAYLELSSLRSDDTAVYYCARGMDRNSPGDYWGQGTPVTVSS

SEQ ID NO: 2990 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSVPRTFGQGTKVEIK

SEQ ID NO: 2991 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGGSGSYLSWFDPWGQGTLVTVSS

SEQ ID NO: 2992 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPGTFGQGTKVEIK

SEQ ID NO: 2993 - protein, 123 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREGAWGGDATDAFDIWGQGTMVTVSS

SEQ ID NO: 2994 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTRVFGGGTKLTVL

SEQ ID NO: 2995 - protein, 125 aa, Homo sapiens
EVQLVESGGGLIQPGGSLRLSCAASGFTVSSNYMSWVRQAPGKGLEWVSVIYSGGRTYYADSVKGRFTISRDNSKNTLYLQMNSLRAEDTAVYYCARDILSTNTVTYPADAFDIWGHGTMVTVSS

SEQ ID NO: 2996 - protein, 110 aa, Homo sapiens
QSALTQPASVSGSPGQSITISCTGTSSDVGVYNYVSWYQQHPGKAPKLMIYEVSNRPSGVSNRFSGSKSGNTASLTISGLQAEDEADYYCSSYTSSSTLVFGGGTKLTVL

SEQ ID NO: 2997 - protein, 127 aa, Homo sapiens
EVQLLESGGGLVQPGGSLRLSCAASGFTFSNYAMSWVRQAPGKGLEWVSLIYTGVPSTYYADSVKGRFTISRDESKKRLYLQMNSLRAEDTAVYFCVGGDCSSTSCQGGYYYGLDVWGQGTTVTVSS

SEQ ID NO: 2998 - protein, 107 aa, Homo sapiens
DIQMTQSPSSLSASVGDRVTITCRASENINIYLNWYLQKPGKAPKLLLYAASSLQSGVPSRFSGSGSGTDFTLTISSLQPEDFAIYYCQQSYSTPLTFGGGTKVEIK

SEQ ID NO: 2999 - protein, 126 aa, Homo sapiens
QLELVQSGPEVKKPGTSVKVSCKTSGFTFTTSAVQWVRQVRGQRLEWIGSIVVGSGNTNYAQTLQERVTISRDLLRSTAYMELSSLRSEDTAIYFCATARITLLRGSVISDAFDMWGQGTMVTVSS

SEQ ID NO: 3000 - protein, 107 aa, Homo sapiens
DIQMTQSPSSLSASVGDRVTITCRASQGISNYLAWYQQKPGKAPKLLIYGGSSLQSGVPSRFSGSGSGTDFTLTINSLQPEDVATYHCQNYNSALLTFGGGTKVEIK

SEQ ID NO: 3001 - protein, 117 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDVQLALDYWGQGTLVTVSS

SEQ ID NO: 3002 - protein, 108 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHYVFGTGTKVTVL

SEQ ID NO: 3003 - protein, 128 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARGPPSNYDILTGYYPYYFDYWGQGTLVTVSS

SEQ ID NO: 3004 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPQTFGQGTKLEIK

SEQ ID NO: 3005 - protein, 118 aa, Homo sapiens
QVQLVESGGGVVQPGRSLRLSCAASGFTFSSYAIHWVRQAPGKGLEWVALISYDGGNKYYADSVKGRFTISRDNSKNTLYLQMNSLRAEDTAVYYCARVMGGSGMDVWGQGTTVTVSS

SEQ ID NO: 3006 - protein, 106 aa, Homo sapiens; identical to SEQ ID NO: 712

SEQ ID NO: 3007 - protein, 131 aa, Homo sapiens
EVQLLESGGGLVQPGGSLRLSCAASGFTFSSYAMSWVRQAPGKGLEWVSVISGSGGSTYYADSVKGRFTISRDNSKNTLYLQMNSLRAEDTAVYYCAKDPVPYYYDSSGYYYGGGDYFDYWGQGTLVTVSS

SEQ ID NO: 3008 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSKTFGQGTKVEIK

SEQ ID NO: 3009 - protein, 121 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARAIGSSWYRGDDYWGQGTLVTVSS

SEQ ID NO: 3010 - protein, 108 aa, Homo sapiens; identical to SEQ ID NO: 716

SEQ ID NO: 3011 - protein, 127 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARDLLGYYDSSGYYYSAAFDIWGQGTMVTVSS

SEQ ID NO: 3012 - protein, 111 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLYVFGTGTKVTVL

SEQ ID NO: 3013 - protein, 123 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPIYDFWSEYYFDYWGQGTLVTVSS

SEQ ID NO: 3014 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTFVVFGGGTKLTVL

SEQ ID NO: 3015 - protein, 118 aa, Homo sapiens
QVHLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATGYGSGSYLFWGQGTMVTVSS

SEQ ID NO: 3016 - protein, 107 aa, Homo sapiens
DIQMTQSPSTLSASVGDRVTITCRASQSISSWLAWYQQKPGKAPKLLIYKASSLQSGVPSRFSGSGSGTEFTLTISSLQPDDFATYYCQQYNSYSRTFGRGTKVDIK

SEQ ID NO: 3017 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKGISGSYYPPYDYWGQGTLVTVSS

SEQ ID NO: 3018 - protein, 106 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWWTFGQGTKVEIK

SEQ ID NO: 3019 - protein, 128 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARALVVPAAMLVDYYYYGMDVWGQGTTVTVSS

SEQ ID NO: 3020 - protein, 111 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGEEVFGGGTKLTVL

SEQ ID NO: 3021 - protein, 125 aa, Homo sapiens
QVQLQESGPGLVKPSQTLSLTCTVSGGSISSGAYYWSWIRQHPGKGLEWVAYMYFTGTTFYNPSLQSRLSISEDTSKNQLSLRLSSVTAADTAVYYCARSSRDSSRDYYYGMDVWGQGTTVTVSS

SEQ ID NO: 3022 - protein, 105 aa, Homo sapiens
SYELTQPPSVSVSPGQTASITCSGDNLGDKYTYWYQQKTGQSPVLVIYQDSKRPSGIPERFSASNSGNTATLTISGTQAMDEADYYCQAWDSRILFGGGTKLTVL

SEQ ID NO: 3023 - protein, 129 aa, Homo sapiens
QVQLQESGPGLVKPSQTLSLTCTVSGGSISSGDYYWSWIRQPAGKGLEWLGRIYTSGSTNYNPSLKSRVTISVDTSKNQFSLKLTSVTAADTAVYYCAGLYCSGGSCPFASFYYGMEVWGQGTTVTVSS

SEQ ID NO: 3024 - protein, 111 aa, Homo sapiens
QSVLTQPPSASGTPGQRVTISCSGSSSNIGSNTVNWYHQLPGTAPKLLIYSNNQRPSGVPDRFSGSKSGTSASLAISGLQSEDEADYYCAAWDDSLNGLYVFGTGTTVTVL

SEQ ID NO: 3025 - protein, 122 aa, Homo sapiens
QLQLQESGPGLVRPSETLSLSCSVSGDSMSSGAYYWAWIRQPPGKGLEWIASLYNSASTVYTPSLKSRLTISMDTSKNQFSLSLTSVTAADTAVYYCARNRSVAGSSFFDFWGQGTRVTVSS

SEQ ID NO: 3026 - protein, 113 aa, Homo sapiens
DIVMTQSPDSLAVSLGERATINCKSSQTIFSTSNNKNYLTWYQHKAGQPPKLLIYWASTRDSGVPDRFSGSGSGTDFTLTITSLQAEDVAVYYCHQHYSFPVTFGQGTKLEIK

SEQ ID NO: 3027 - protein, 116 aa, Homo sapiens
EVQLVESGGVLVQPGGSLRLSCAASGFSFTTYDMHWVRQGTGQGLEWVSGIGTAGDTYYSDSVKGRCTISRDNAKNSLYLQMKSLRAADRAVYYCARGVGGIIDYWGQGTPVTVSS

SEQ ID NO: 3028 - protein, 110 aa, Homo sapiens
NFVLTQPHSVSESPGKTVTISCTGNSGSIATKYVQWFQQRPGSAPTTVIYEDNQRPSGVPDRFSGSSDSSSNSASLTISGLKTEDEADYYCQSYHNRRWVFGGGTKLTVL

SEQ ID NO: 3029 - protein, 127 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCATRMFSWGNYREVGYYFDYWGQGTLVTVSS

SEQ ID NO: 3030 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTWVFGGGTKLTVL

SEQ ID NO: 3031 - protein, 123 aa, Homo sapiens
QVQLVQSGAEVKKPGASVKVSCKASGYTFTDHYIHWVRQAPGQGLEWMGWINPNSGGTKYGQKFQGRVTMTRDTSITTAYMDLGRLRSDDTAVYYCAREAAYGSGNLNWFDPWGQGTLVTVSS

SEQ ID NO: 3032 - protein, 110 aa, Homo sapiens
NFMLTQPHSVSESPGKTVTISCTGSSGSIASNYVHWYQQRPGSAPTTVIYEDNQRPSGVPDRFSGSIDSSSNSASLTISGLKTEDEADYYCQSYDSDSWVFGGGTKLTVL

SEQ ID NO: 3033 - protein, 122 aa, Homo sapiens
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATAPGIAARDRWFDPWGQGTLVTVSS

SEQ ID NO: 3034 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSHQGYTFGQGTKLEIK

SEQ ID NO: 3035 - protein, 130 aa, Homo sapiens
QVQLQESGPGLVRPSETLSLTCSVSGGFTSDYYWSWIRQPAGKGLEWIGRIFSSVSTNYNPSLKSRVTMSVDTSRSQFSLQLDSVTAADTAVYYCARGRITLNYASGRNSNFYYYGMDVWGQGTTVTVSS

SEQ ID NO: 3036 - protein, 107 aa, Homo sapiens
DIQMTQSPSSLSASVGDRVTFTCRASQTITNYLNWYQQKPGKAPKLLIYAASTLQSGVPSRFSGSGSGTDFTLTISSLQPEDFATYYCQQSYSTPLTFGPGTKVDIR

SEQ ID NO: 3037 - protein, 123 aa, Homo sapiens
QDQLVQSGAEVKKPGSSVKVSCQASGGTFDTYTVSWVRQAPGQGLEWMGRIIPMLGIVNYARKFQGRVTITADKSTGTAYLDVTSLISNDTAVYFCARDRGSYSSREWYFDLWGRGTLVTVSS

SEQ ID NO: 3038 - protein, 107 aa, Homo sapiens
DIQMTQSPSSLSASVGDRVTITCRASQGISNYLAWYQQKPGRVPELLIYGASTLHSGVPPRFSGSGSGTDFTLTISSLQPEDVATYFCQNYNTALRGFGQGTKVEIK

SEQ ID NO: 3039 - protein, 126 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDEGGSYLGDYYYYGMDVWGQGTTVTVSS

SEQ ID NO: 3040 - protein, 110 aa, Homo sapiens; identical to SEQ ID NO: 860

SEQ ID NO: 3041 - protein, 127 aa, Homo sapiens
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGASITIFGVVIQYYGMDVWGQGTTVTVSS

SEQ ID NO: 3042 - protein, 105 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSRTFGQGTKVEIK

SEQ ID NO: 3043 - protein, 124 aa, Homo sapiens
EVQLVESGGGLVQPGGSLRLSCAASQFTFSNYWMSWVRQAPGKGLEWVANIKQDGSDKYYVDSVKGRFTISRDNAKNSLYLQINSLRAEDTALYYCARGLRQYSTRDYYGMDVWGQGTTVTVSS

SEQ ID NO: 3044 - protein, 111 aa, Homo sapiens
QSVLTQPPSVSGAPGQRVTVSCTGSSSNIGAGYDVQWYQQLPGTAPKLLIYANSNRPSGVPDRFSGSKSGTAASLAITGLQAEDEADYYCQSYDTGLRGSVFGGGTKLTVL

SEQ ID NO: 3045 - protein, 124 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDGQSSGWPGDDAFDIWGQGTMVTVSS

SEQ ID NO: 3046 - protein, 108 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDHWVFGGGTKLTVL

SEQ ID NO: 3047 - protein, 122 aa, Homo sapiens
QVQLVQSGSDLKKPGASVKVSCQTSGYTFTDHAMNWVRQAPGQGLEWLGWINTNTGNPTYAQDFPGRFVFSLDTSVSTAYLQISRLQADDTAVYFCARASARPGVATNFDYWGQGTLVIVSS

SEQ ID NO: 3048 - protein, 107 aa, Homo sapiens
DIQMTQSPSSLSASVGDRVTITCRASQSIDNYLNWYQQKPGKAPSLLIYAASRLHSGVPSRFSGTGSGTDFTLIISSLQPEDLATYYCQQSYSNPLTFGPGTKVDIR

SEQ ID NO: 3049 - protein, 122 aa, Homo sapiens
EVQLVESGGGLVQPGRSLRLSCAASGFNFHDYAMHWVRQAPGKGLEWVSGINWNSGEIVYADSVKGRFTISRDNAKNSLFLQMNRLKTEDTAFYYCAKDSVVRGVYDSFDFWGQGTMVTVSS

SEQ ID NO: 3050 - protein, 107 aa, Homo sapiens
DIQMTQSPSSLSASIGDRVTITCRSSQSIITYLNWFQHIPGKAPKLLIYAASSLQSGVPSRFSASGSGTDFTLTIGSLQPEDFATYYCQQSYSLPLTFGGGTKVEIR

SEQ ID NO: 3051 - protein, 122 aa, Homo sapiens
EVQLVESGGGLAQPGRSLRLSCEASGFNFHDYGMHWVRQAPGKGLEWVSGIGWNSATIGYADSVKGRFIISRDNAKKSLYLQMNSLRPDDTAFYYCVKGSGISLWGVWFDPWGQGTLVTVSS

SEQ ID NO: 3052 - protein, 107 aa, Homo sapiens
DIQMTQSPSSVSASVGDTVTITCRASQDISTWLAWYQQKPGRVPELLIYTASSLQSGVPSRFSGSGSGTDFTLTISSLQPEDFATYFCQQANGFPFTFGQGTRLEMK

SEQ ID NO: 3053 - protein, 121 aa, Homo sapiens
QVHLVESGGGVVQPGRSLRLSCAASGFTFSDYAIHWVRQAPGKGLEWVAVISYDGRNKFYTDSVKGRFTISRDNSKNTLYLQMNSLSSEDTAMYYCARVAHQYGGPYFDYWGQGTLVTVSS

SEQ ID NO: 3054 - protein, 107 aa, Homo sapiens
DIQMTQSPSSVSASVGDRVTITCRASQGINSWLAWYQQKPGKAPKLLIYSASNLQSGVPSRFSGSGSGTDFTLTISSLQPEDFATYYCQQANSFPYTFGQGTKLEIR

SEQ ID NO: 3055 - protein, 123 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDFTIVVVIAVRIDYWGQGTLVTVSS

SEQ ID NO: 3056 - protein, 111 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSSQGVFGGGTKLTVL

SEQ ID NO: 3057 - protein, 120 aa, Homo sapiens
QVQLQEAGPGLVRPSETLALTCNVSGHSISSGHYWSWIRQAPGKQLEWIGNVNRIGTTYYNPSLKNRVIISVDTSKNQVSLKLTSVTAADTAVYFCARDAAGPMSGMDVWGQGTMVSVSS

SEQ ID NO: 3058 - protein, 110 aa, Homo sapiens
AYVLTQPPSVTVAPGKTANISCGGDNIESQSVHWYQQKPGQAPVRVIFYDIDRPSGIPERFSGSTSGNTATLTISRVEAGDEADYFCQVWDSSSLHPGYVFGSGTTVFVL

SEQ ID NO: 3059 - protein, 130 aa, Homo sapiens
QLQLQESGPGLVKPSETLSLTCTVSGGSISSRSYYWAWIRQPPGKGLEWIGNIYGSGSAYYNPSLKSRVAISVDTSKNQFSLKLTSVTAADTAVYYCAREAVVVVPATPNSRGGGEVDSWGQGTLVTVSS

SEQ ID NO: 3060 - protein, 113 aa, Homo sapiens
DIVMTQSPDSLAVSLGERATINCKSSQSVLYSSNNKNYLAWYLQKPGHPPKLLIYWASTRESGVPDRFSGSGSGTDFTLTISSLQAEDVAVYYCQQYYSTPNTFGQGTKLEIK

SEQ ID NO: 3061 - protein, 121 aa, Homo sapiens
QVQLVESGGGVVQPGRSLRLSCAASGFIFNAYAMHWVRQAPGKGLEWVAVTSYDGNKKHYADSVKGRFTISRDNSKNTLYLQMNSLRPEDTAVYYCAKDEYSGYDLIIGYWGQGTRVTVSS

SEQ ID NO: 3062 - protein, 110 aa, Homo sapiens
NFMLTQPHSVSESPGKTVTISCTGSSGSIAGNYVQWYQQRPGSAPTTVIYEHNQRPSGVPDRFSGSFDSSSNSASLTISGLKTEDEADYYCQTYDSSTVVFGGGTKLTVL

SEQ ID NO: 3063 - protein, 124 aa, Homo sapiens
QITLKESGPPLVRPTQTLTLTCTFSGFSLSRTGVGVGWIRQPPGKALEWLALIYWDGDERYNPSLKTRLTITKNTSKNQVVLMMAKMDPADTATYYCLHSLTTFGLPDYAVDVWGQGTPVTVSS

SEQ ID NO: 3064 - protein, 108 aa, Homo sapiens
EIVMTQSPATLSVSPGDRATLSCRASRSVDTNLAWYRQKPGQPPTLLIYGASTRATGIPARFSGSGSETDFTLTISSLQSDDFAVYYCQQYNNWPWITFGQGTRLEIK

SEQ ID NO: 3065 - protein, 120 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARFIGSGYYHFDYWGQGTLVTVSS

SEQ ID NO: 3066 - protein, 108 aa, Homo sapiens
SYELTQPPSVSVSPGQTARITCSGDALPKKYAYWYQQKSGQAPVLVIYEDSKRPSGIPERFSGSSSGTMATLTISGAQVEDEADYYCYSTDSSGNHRVFGGGTKLTVL

SEQ ID NO: 3067 - protein, 130 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDSVSPYYYDSSGYYYHRYFDYWGQGTLVTVSS

SEQ ID NO: 3068 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTVVFGGGTKLTVL

SEQ ID NO: 3069 - protein, 122 aa, Homo sapiens
QVQLQESGPGLVKPSQTLSLTCTVSGASISSGSYYWNWIRQPAGKGLEWIGRIYTSSTTNYNPALESRLTMSVDMSRNQFSLKLTSVTAADTAVYYCARTDCGGDCHSLAYWGQGTLVTVSS

SEQ ID NO: 3070 - protein, 102 aa, Homo sapiens
EVVLTQSPATLSLSPGERATLFCRASQIVSSYLAWYQQKPGQAPRLLIYDASNRATGIPARFSGSGSGTDFTLTISSLEPEDFAVYYCQHLAFGGGTKVEIK

SEQ ID NO: 3071 - protein, 123 aa, Homo sapiens
QVQLVESGGGVVQPGRSLRLSCAASGFTFRNYAMHWVRQAPGKGLEWVAVISYDGSNKYYADSVKGRFTISRDKSKNTLHLQMNSLRAEDTAVYYCAKDWGDGIVGPTTVDYWGQGTLVTVSS

SEQ ID NO: 3072 - protein, 107 aa, Homo sapiens
DIQMTQSPSSLSASVGDRVTITCRASQGISNYLAWYQQKPGKGPDLLIYAASTLQSGVPSRFSGSGSGTDFTLTISSLQPEDFATYYCQKYNSAPWTFGQGTKVEIK

SEQ ID NO: 3073 - protein, 132 aa, Homo sapiens
QVQLVQSGAEVKKPGASVMVSCKASGYTFTGYHMHWVRQAPGQGLEWMGWINPSTGGTNYAQKFQDRVTVTRDTSISTAYMELSRLRSDDTAVYYCASQRVTSGYSSGWYFSELKVYGLDVWGQGTTVTVSS

SEQ ID NO: 3074 - protein, 109 aa, Homo sapiens
EIVLTQSPGTLSLSPGERVTLSCRASQSVASSYLAWYQQKPGQAPRLLIDGASSRATGIPDRFSGSGSGTDFTLTISRLEPEDFAVYYCQQYGSSPALTFGGGTKVEIK

SEQ ID NO: 3075 - protein, 119 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVFYCARMGVADWYFDLWGRGTLVTVSS

SEQ ID NO: 3076 - protein, 106 aa, Homo sapiens
SYELTQPPSVSVSPGQTASITCSGDKLGDKYACWYQQKPGQSPMLVIYQDSKRPSGIPERFSGSNSGNTATLTISGTQAMDEADYYCQAWDSSTGVFGTGTKVTVL

SEQ ID NO: 3077 - protein, 129 aa, Homo sapiens
QLQLQESGPGLVKPSETLSLTCTVSGGSISNNNYYWGWIRQPPGKGLEWIGSISYSGSTYYSPSLKSRVSISLDTSKSHFSLTLTSVTAADTAEYYCARDSGSSSWSGAYYYYYGMDVWGQGTTVTVSS

SEQ ID NO: 3078 - protein, 107 aa, Homo sapiens
DIQMTQSPSSLSASVGDSVTITCRASQSIGSWLAWYQQKPGRAPKLLIYKASSLDTGVPSRFSGSGSGTEFTLTINGLQPDDFATYYCHQYNSYSRTFAQGTKVEIK

SEQ ID NO: 3079 - protein, 119 aa, Homo sapiens
EVQLVESGGGLVQPGGSLRLSCAASGFTFSSYWLTWVRQAPGKGLEWVANIKQDGSEKYYVDSVKGRFTISRDNAKNSLYLQMNSLRAEDTAVYYCARLSSSSWHFDYWGQGTLVTVSS

SEQ ID NO: 3080 - protein, 106 aa, Homo sapiens
SYELTQPPSVSVSPGQTASITCSGDKLGDKYACWYQQKPGQSPVLVIYQDFKRPSGIPERFSGSNSGNTATLTISGTQAMDEADYYCQAWDSSTGVFGTGTKVTVL

SEQ ID NO: 3081 - protein, 119 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVGSSSWFWNYWGQGTLVTVSS

SEQ ID NO: 3082 - protein, 107 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTGGVFGGGTKLTVL

SEQ ID NO: 3083 - protein, 123 aa, Homo sapiens
QVQLQESGPGLVKPSETLSLTCIVSDGSVSSGSYYWSWIRQPPGKGLEWIGYIYYTGSTNYNPSLKSRVTISVDRSKSQYSLKVRSVTAADSAVYYCARVSWYDSDRYTMDVWGQGTTVTVSS

SEQ ID NO: 3084 - protein, 112 aa, Homo sapiens
DIVMTQSPLSLPVTPGEPASISCRSSQSLLHTNGYNYLDWYLQKPGQSPQLLIYLGSNRASGVPDRFRGSGSGTDFTLKISRVEAEDVGVYYCMQSQQTPWTFGQGTKVEIK

SEQ ID NO: 3085 - protein, 125 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCASLRYFDWLLTTDDAFDIWGQGTMVTVSS

SEQ ID NO: 3086 - protein, 107 aa, Homo sapiens; identical to SEQ ID NO: 2858

SEQ ID NO: 3087 - protein, 120 aa, Homo sapiens
EVQLVESGGGLVQPGGSLRLSCAASGFTFSSYWLSWVRQAPGKGLEWVANIKQDGTEKYYVDSVKGRLTISRDNAKNSLYLQMNSLRAEDTAVYYCARELIPAAGSFDYWGQGTLVTVSS

SEQ ID NO: 3088 - protein, 106 aa, Homo sapiens
SSELTQPPSVSVSAGQTASITCSGDKLGNKYVSWYQQRPGQSPLLVIYQDRKRPSGIPERFSGSNSGNTATLTISGTQVMDEADYYCQAWDSSTVVFGGGTKLTVL

SEQ ID NO: 3089 - protein, 123 aa, Homo sapiens
QVQLQESGPGLVKPSETLSLTCTVSGGSVSSGSYYWSWIRQPPGKGLEWIGYIYYTGSTNYNPSLKSRVTISVDRSKNQFSLKLRSVTAADTAVYYCARVSWYDADRYTMDVWGQGTTVTVSS

SEQ ID NO: 3090 - protein, 112 aa, Homo sapiens
EIVMTQSPLSLPVTPGEPASISCRSSQSLLHTNGYNYLDWYLQKPGQSPQLLIYLGSNRASGVPDRFRGSGSGTDFTLKISRVEAEDVGVYYCMQSQQTPWTFGQGTKVEIK

SEQ ID NO: 3091 - protein, 125 aa, Homo sapiens
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARGGFWSGYYNTRAWAFDIWGQGTMVTVSS

SEQ ID NO: 3092 - protein, 107 aa, Homo sapiens; identical to SEQ ID NO: 2862

SEQ ID NO: 3093 - protein, 122 aa, Homo sapiens; identical to SEQ ID NO: 987

SEQ ID NO: 3094 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK

SEQ ID NO: 3095 - protein, 124 aa, Homo sapiens
EVQLVQSGAEVKKPGATVKISCKVSGYTFTDYYMHWVQQAPGKGLEWMGLVDPEDGETIYAEKFQGRVTITADTSTDTAYMELSSLRSEDTAVYYCATDFSPPLYSSSSGFDYWGQGTLVTVSS

SEQ ID NO: 3096 - protein, 108 aa, Homo sapiens
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDPVVFGGGTKLTVL

SEQ ID NO: 3097 - protein, 118 aa, Homo sapiens
QVQLVQSGAEVKKPGASVKVSCKASGYTFTSYYMHWIRQAPGQGLEWLAMINPIGGFTKYAQKFQGRVTVTRDTSTSTVYLEMRSLRSEDTALYYCARETQQWTGDYWGQGSLVIVSS

SEQ ID NO: 3098 - protein, 110 aa, Homo sapiens
QSALTQPPSVSGSPGQSVTVSCTGTSSDIGSYNRVSWYRQPPGTAPKLIIYEVSNRPSGVPDRFSGSKSGNTASLTISGLQAEDEADYYCSSYTSSSTLIFGGGTKLTVL

SEQ ID NO: 3099 - protein, 126 aa, Homo sapiens
DVILLESGGGLVQPGGSLRLSCSASGFPFSDHVMSWVRQPPGKGLEWVSIIYRSGTTYYSPSVKGRFTISRDDSKSTLYLQMDSLRVDDTAIYRCARYLVPVPHRAYYFYYGMDVWGQGTTVTVSS

SEQ ID NO: 3100 - protein, 112 aa, Homo sapiens
EIVMTQSPLSLPVTPGEPASISCTSSQSLLHSNGYKYLDWYVQKPGQSPQLLIYLGSNRASGVPDRFSGSGSGTDFTLKISRVEAEDVGIYYCMHALQIPFTFGQGTKLEIK

SEQ ID NO: 3101 - protein, 115 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARGPYGESVWGQGTTVTVSS

SEQ ID NO: 3102 - protein, 107 aa, Homo sapiens; identical to SEQ ID NO: 666

SEQ ID NO: 3103 - protein, 120 aa, Homo sapiens
EVQLLESGGGLVQPGESLRLSCTSSGFTFSNYVMSWVRLAPRKGLEWLSVIYTGSSGSQYADSVKGRFTISRDDSKNMLYLQMDSLTAEDTALYYCARRGSGIYYNFDYWGQGILVTVST

SEQ ID NO: 3104 - protein, 107 aa, Homo sapiens
AIQMTQSPSPLSASVGDRVTITCRASQGIGNDLGWYQQKPGKAPKLLIYGASTLQSGVPSRFSGSGSGTDFTLTISSLQPEDFATYYCLQDYIYPLTFGPGTKVDIK

SEQ ID NO: 3105 - protein, 120 aa, Homo sapiens
QVQLVESGGGVVQPGRSLRLSCEASDFIFRNYLMHWVRQAPGKGLEWVALISFDGSTTKFADSVKGRFSVSRDNSKNTLYLQLNSLRSDDTAVYYCARGGSSGNDAFDIWGQGTLVTVSS

SEQ ID NO: 3106 - protein, 112 aa, Homo sapiens
DVVMTQSPLSLPVTLGQPASISCRSSQSLVYSDGNIYFNWFQQRPGQSPRRLIYKVSKRDAGVPDRFSGSGSGTDFTLKISRVEAEDVGIYYCMQATHWPITFGQGTRLEIK

SEQ ID NO: 3107 - protein, 116 aa, Homo sapiens
EVQLVESGGVLVQPGGSLRLSCAASGFSFSSYDMHWVRQGTGKGLEWVSGIGTAGDRYYSDSVKGRCTISRDNGKNSLYLQLKSLRAADRAVYYCARGVGGIIDYWGQGTPVTVSS

SEQ ID NO: 3108 - protein, 110 aa, Homo sapiens
NFVLTQPHSVSESPGKTVTISCTGNSGSIATKYVQWFQQRPGSAPTTVIYEDNQRPSGVPDRFSGSSDSSSNSASLTISGLKTEDEADYYCQSYHNRRWVFGGGTRLTVL

SEQ ID NO: 3109 - protein, 126 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARTRRGGLAVAAPNWFDPWGQGTLVTVSS

SEQ ID NO: 3110 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSPLTFGGGTKVEIK

SEQ ID NO: 3111 - protein, 122 aa, Homo sapiens; identical to SEQ ID NO: 2755

SEQ ID NO: 3112 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPITFGQGTRLEIK

SEQ ID NO: 3113 - protein, 118 aa, Homo sapiens
EVQLVESGGGLIQPGGSLRLSCATSGFTVSSNFMSWVRQAPGMGLEWVSIIYSGGKTFYAESVRGRFTISRDNSKSTIYLQMNNLRVEDTAVYFCARTTAAAGDFDYWGQGTLVTVSS

SEQ ID NO: 3114 - protein, 108 aa, Homo sapiens
SSELTQDPAVSVALGQTVRITCQGASLSTYYTNWYQQKPGQAPVRVIYGKNHRPSGIPDRFSASRSGNTASLTITGAQAEDEADYYCNSWDNSGDLPVFGGGTKLTVL

SEQ ID NO: 3115 - protein, 119 aa, Homo sapiens
EVQLLESGGGLVQPGGSLRLSCAASGFTFSIYAMSWVRQAPGKGLEWVSAISGSGGSTYYADSVKGRFTISRDNSKNTLYLQMNSLRAEDTAVYYCAKDLGDSYGMDVWGQGTTVTVSS

SEQ ID NO: 3116 - protein, 102 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAGVVFGGGTKLTVL

SEQ ID NO: 3117 - protein, 128 aa, Homo sapiens
QVQLVQSGAEVKKPGASVKVSCKAFDYTFPTYGISWVRQAPGQGLEWMGWISVYNGNTNYAQKFQGRVTMTTDTSTSTAYMELRSLRSDDTAVYYCARDPWQHIVVVPAATSYGMDVWGQGTTVTVSS

SEQ ID NO: 3118 - protein, 108 aa, Homo sapiens
EIVLTQSPATLSLSPGERATFSCRASQSVSSYLAWYQQKPGQAPRLLIYDASNRATGIPARFSGSGSGTDFTLTISSLEPEDFAVYYCQQRSNWAPSTFGQGTRLEIK

SEQ ID NO: 3119 - protein, 124 aa, Homo sapiens
EVQLVESGGGLVQPGRSLRLSCAASGFTFNEYAMYWVRQAPGRGLEWVSGIDWNSGHIGYADSVKGRFTISRDNTNNSVYLQMDSLRPEDTALYYCAKDKVPYYDILTGFLDSWGQGTLLIVSS

SEQ ID NO: 3120 - protein, 107 aa, Homo sapiens
AIQMTQSPSTLSASVGDRVTITCRASQSIITWLAWYQQKPGKVPKLLIYKAASLESGVPARFSGSRSGTEYTLTINSLQPDDFASYYCQQYKTYPHTFGQGTKLEIK

SEQ ID NO: 3121 - protein, 125 aa, Homo sapiens
QMQLVQSGPEVKKPGTSVKVSCKASGVTFTNSAVQWVRQARGQARGQRLEWIGWIVVGSGKTNYAQKFQERVTITRDMSTRTVYMNLSSLRSDDTAVYYCAAFYWGTGWYYFDYWGQGTLVTVSS

SEQ ID NO: 3122 - protein, 108 aa, Homo sapiens
EIVMTQSPATLSVSPGERATLSCRASQRVSSNLAWYQQKPGQAPRLLIYGASTRATGIPARFSGSGSGTEFTLTIDSLQSEDFAVYYCQQYNNWPPLTFGGGTMLEIK

SEQ ID NO: 3123 - protein, 123 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCASCAFCLISGWYHFDYWGQGTLVTVSS

SEQ ID NO: 3124 - protein, 108 aa, Homo sapiens; identical to SEQ ID NO: 952

SEQ ID NO: 3125 - protein, 120 aa, Homo sapiens
QVQLQESGPGLVKPSQTLSLTCTVSGGSISSGGYYWSWIRQHPGKGLEWIGYIFYSGSTYYNPSLKSRVTISVDTSKNHFSLKVSSVTAADTAVYYCARDPAPRKGPVIWGQGTMVTVSA

SEQ ID NO: 3126 - protein, 110 aa, Homo sapiens
QSALTQPASVSGSPGQSITISCTGTNSDIGSYNFVSWYQQHPGKAPKLMIYEVSNRPSGVSNRFSGSKSGSTASLTISGLQAEDEADYYCSSFTRSTTVVFGGGTKLTVL

SEQ ID NO: 3127 - protein, 116 aa, Homo sapiens
QVQLVQSGAEVKKPGASVKVSCKASGYTFTSYYMHWVRQAPGQGLEWMGIINPSGGSTGYAQKFQGRITMTRDTSTSTVYMELSSLRSEDTAVYYCARVGGSMDVWGQGTTVTVSS

SEQ ID NO: 3128 - protein, 108 aa, Homo sapiens
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPITFGQGTRLEIK

SEQ ID NO: 3129 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAWSGSYYGAFDIWGQGTMVTVSS

SEQ ID NO: 3130 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLGVFGTGTKVTVL

SEQ ID NO: 3131 - protein, 128 aa, Homo sapiens; identical to SEQ ID NO: 1103

SEQ ID NO: 3132 - protein, 110 aa, Homo sapiens
QSALTQPPSVSGSPGQSVTISCTGTSSDVGSYSRVSWYQQPPGTAPKLMIYEVSNRPSGVPDRFSGSKSGNTASLTISGLQAEDEADYYCSSNTSSTTLIFGGGTKLTVL

SEQ ID NO: 3133 - protein, 128 aa, Homo sapiens; identical to SEQ ID NO: 901

SEQ ID NO: 3134 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPALTFGGGTKVEIK

SEQ ID NO: 3135 - protein, 125 aa, Homo sapiens
QIQLVQSGAEVKKPGAAVKVSCKASGYTFTSYGISWVRQAPGQGLEWMGWISTYNGNTNYAQNLQDRVTMTTDTSTSTAYMELRSLRSDDTAVYFCARDKDEGANSWYGDWFDPWGQGTLVTVAS

SEQ ID NO: 3136 - protein, 110 aa, Homo sapiens
SYELTQPPSVSVSPGQTASITCSGDKLGDKYVGWYQQKPGQSPVLVIYHDNKRPSGIPERFSGSNSGSNSGNTATLTVSGTEAMDEADYFCQAWDSSSVFFGGGTKLTVL

SEQ ID NO: 3137 - protein, 120 aa, Homo sapiens; identical to SEQ ID NO: 1143

SEQ ID NO: 3138 - protein, 113 aa, Homo sapiens
DIVMTQSPDSLAVSLGERATINCKSSQSILSSSNNRNYLAWYQQKPGQPPKLFIYWASTREAGVPDRFSGSGSGTDFSLTISSLQAEDVAVYYCQQYYENALTFGGGTKVEIK

SEQ ID NO: 3139 - protein, 125 aa, Homo sapiens
QVQLVESGGGVVQPGRSLRLSCAASGFIFRTYAMHWVRQAPGKGLEWVASISYDGEIKYYGDSVKGRFTISRDNSKDTLYLEMNSLRPEDTAIYYCPKDAPGTYYHRGFNWFDPWGQGTLVTVSS

SEQ ID NO: 3140 - protein, 107 aa, Homo sapiens
EIVLTQSPATLSLSPGERVTLSCRASQSVSSYMAWYQQKPGQAPRLLLYDASNRATGIPARFSGSGSGTDFTLSISSLEPEDFAVYYCQQRSSWPLTFGGGTKVEIK

SEQ ID NO: 3141 - protein, 121 aa, Homo sapiens
QVQLVESGGGVVQPGRSLRLSCAASGFTFRSYAIHWVRQAPGKGLEWVAVISFDGSNNYYADSVKGRFTISRDNSKNTLYLQMNSLRAEDTAVYYCAKDRSGNYYYGMDVWGQGTTVTVSS

SEQ ID NO: 3142 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTLGTFGPGTKVDIK

SEQ ID NO: 3143 - protein, 121 aa, Homo sapiens
QVQLVESGGGVVQPGRSLRLSCAASGFTFATYAMHWVRQAPGKGLEWVAVISHDGSNKHYADSVKGRFTISRDNSKNTLYLQMNSLRAEGTAIYYCARESLEAAAPPFDYWGQGTLVTVSS

SEQ ID NO: 3144 - protein, 107 aa, Homo sapiens
SYELTQPPSVSVSPGQTATITCSGDKLGEKYASWYQQKPGQSPALVIYQDRKRPSGIPERFSGSNSGNTATLTISGTQAMDEADYYCQAWDSSNSVVFGGGTKLTVP

SEQ ID NO: 3145 - protein, 115 aa, Homo sapiens
QITLKESGPTVVKPTQTLTLTCSFSGFSLSMGGVGVHWIRQPPGKALEWLALIHWNDKKDYSPSLKRRLSISKDTSKNQVVLTMTNMDPVDTATYFCAHNMGDYWGQGTLVTVSS

SEQ ID NO: 3146 - protein, 111 aa, Homo sapiens
QSVLTQPPSASGTPGQRVTISCSGSRSNIGTNTVNWYQQLPGAAPKLLIFSNNLRPSGVPDRFSASKSGTSASLAISGLQSEDEADYYCAAWDDSLNGFYVFGTGTWVTVL

SEQ ID NO: 3147 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARATRGSYYWGGDYWGQGTLVTVSS

SEQ ID NO: 3148 - protein, 108 aa, Homo sapiens; identical to SEQ ID NO: 1134

SEQ ID NO: 3149 - protein, 116 aa, Homo sapiens
QVQLQESDPGLVKPSGTLSLTCAVSGGSITNDNWWSWVRQSPGKGLEWIAEIFHSGSANYNPSLKTRVTISMDMSRNQFSLNMKSLTAADTAVYYCARGGSWFPVWGPGTLVTVSS

SEQ ID NO: 3150 - protein, 107 aa, Homo sapiens
DTQMTQSPSTLSASVGDRVTITCRASQNIHRWLAWYQQKPGTAPKVLIYEASNLQSGAPSRFSGSGFGTEFTLTISSLQPDDFATYYCQQYHGYPWTFGQGTKVEVK

SEQ ID NO: 3151 - protein, 117 aa, Homo sapiens
QVQLVQSGAEVKKPGASVKVSCKASGYTFTSYYMHWVRQAPGQGLEWMGIISPSGGSTSYAQKFQGRVTMTRDTSTSTVYMELSSLRSEDTAVYYCASAIYYGMDVWGQGTTVTVSS

SEQ ID NO: 3152 - protein, 111 aa, Homo sapiens
QSALTQPASVSGSPGQSITISCTGTSSDVGGYNYVSWYQHHPGKAPKLMIYEVSNRPSGISNRFSGSKSGNTASLTISGLQAEDEAHYYCSSYTSSSTPYVFGTGTKVTVL

SEQ ID NO: 3153 - protein, 128 aa, Homo sapiens
QVQLQESGPGLVKPSETLSLTCTVSGGSITTISYYWGWIRQPPGKGLEWIGSLYFSGSSYYNPSLKSRITVSVDTSKNHFSLNLSSVTAADTAVYYCGLVEPGYYDFRTDYSPFFDSWGHGILVTVSS

SEQ ID NO: 3154 - protein, 109 aa, Homo sapiens
EIVMTQSPATLSVSPGERATLSCRASQSVSNNLAWYQQKLGQAPRLLIYGASTRATGIPVRFSGSGSGTEFTLTISSLQSEDFAVYYCQQYYSWPPFLTFGGGTKVEIK

SEQ ID NO: 3155 - protein, 123 aa, Homo sapiens
QVQLQESGPGLVKPSETLSLICTVSGGSISGYHWNWIRQPPGKGLEWIGYIYYTGSTNYNPSLKSRITISVDKSKNQFSLKLSSVTAADTAVYYCAREIYDFWSGYQYGMDVWGQGTTVTVSS

SEQ ID NO: 3156 - protein, 106 aa, Homo sapiens
EIVLTQSPATLSLSPGERATLSCRASQTVSRYLAWYQQKPGQAPRLLIYDASNRALGIPARFSGSGSGTDFTLTISSLEPEDFAVYYCQQRTNWPTFGQGTKVEIK

SEQ ID NO: 3157 - protein, 122 aa, Homo sapiens
EAHLAESGGDLVQPGGSLRLSCVVSGFTVNSYYMSWVRQAPGKGLEWVSIIYNGGETFYEDSVKGRFTISRDNSKNTLFLQMHSLRVEDTAVYYCARSSLVEGIYHQALDVWGQGTMVTVSS

SEQ ID NO: 3158 - protein, 107 aa, Homo sapiens
AIRMTQSPSSVSASTGDRVTITCRASQDIRSYLAWYQQTPGKAPKLLIHSASTLQSGIPSRFSGSGSGTDFTLTISRLQSEDFATYYCQEYESYPLSFGGGTKVEIK

SEQ ID NO: 3159 - protein, 127 aa, Homo sapiens
QVQLQESGPGLVKPSGTLSLTCGVSGDSITSKNWWSWVRQPRGKGLEWIGDVYHVGMAEYNPSLKSRVTMSVDTSKNQFSLKLTSVTAADTAVYYCARTLGFDFWSGYPERLGLDVWGQGTTVTVSS

SEQ ID NO: 3160 - protein, 106 aa, Homo sapiens
DIQLTQSPSFLSASAGDRVTIPCRASQAIVRYLAWYQQKPGKAPNLLIYAASTLHSGVPSRFSGSGSGTDFTLTISSVQPEDSATYYCQQLNNYVSFGQGTKLEIR

SEQ ID NO: 3161 - protein, 128 aa, Homo sapiens
QVQLEQSGAEVKKPGSSVKVSCTAPGDTFTTYAISWVRQAPGQGLEWMGRIVPVLGLSNYTQTLQGRVTITADRSTTTAYMELTSLRSTDTAVYYCARHRITVIQGLLMHTNNFFDSWGQGTLITVSS

SEQ ID NO: 3162 - protein, 108 aa, Homo sapiens
EIIMTQSPATLSVSPGERATLSCRASQSVGSNLAWYQQKPGQAPRLLIYRASTRATGVPARFSGSGSGTEFTLTISSLQSEDFAVYFCQQSTNWPPITFGPGTKVDFK

SEQ ID NO: 3163 - protein, 122 aa, Homo sapiens
EVQLVESGGGLVQPGGSLRLSCAASGFIFSDHYIDWIRQAPGKGLEWVCRSRNKAHSYTTEYAASVKGRFSISRDDSKNSLYLQMNSLKTEDTAVYYCVRAGDSPPEPFRTWGQGTMVTVSS

SEQ ID NO: 3164 - protein, 107 aa, Homo sapiens
DIQMTQSPSSLSASVGDRVTITCRASQSISSWLAWYQQKPGKAPKLLIYKASTLEIGVPSRFSGSGSGTEFTLTISSLQPDDFATYYCQHYQSYPLTFGGGTNVEIK

SEQ ID NO: 3165 - protein, 121 aa, Homo sapiens
QVQLQGSGPGLVRPSQTLSLTCTVSGGSINSGGYYWSWIRQHPGKGLEWIGYIYYSGSTYYSPSLKSRLTISMDTSKNQFSLKLSSVTAADTAVYYCARDTGYDLYAFDMWGQGTMVTVSS

SEQ ID NO: 3166 - protein, 111 aa, Homo sapiens
QSVLTQPPSASGTPGQRVTISCSGSSSNIGSYYVYWYQELPGTAPKLLIYRNDQRPSGVPDRFSGSKSGTSASLAISGLRSEDEADYYCAAWDDSLSGFYVFGTGTKVTVL

SEQ ID NO: 3167 - protein, 134 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDGHYYGSGSYYYPLRDYYYYYGMDVWGQGTTVTVSS

SEQ ID NO: 3168 - protein, 109 aa, Homo sapiens
SSELTQDPAVSVALGQTVRITCQGDSLRSYYASWYQQKPGQAPVRVIYGKNNRPSGIPDRFSGSSSGNTASLTITGAQAEDEADYYCNSWDSSGNHHVVFGGGTKLTVL

SEQ ID NO: 3169 - protein, 125 aa, Homo sapiens
EVQLVESGGGLVQPGRSLRLSCAASGFTFDDYAMHWVRQGPGKGLEWVSGISWNSGSIGYADSVQGRFTISRDNAKNSLYLEMNSLRAEDTALYYCAKDVVYKGYTYGQGYSDYWGQGTLVTVSS

SEQ ID NO: 3170 - protein, 108 aa, Homo sapiens
DIQMTQSPSSLSASVGDRVTITCRPSQSISSYLNWYQQKPGKAPKLLIYAASNLRSGVPSRFSGSESGPDFTLTISSLQPEDFATYYCQQTYSIPPITFGQGTRLDIK

SEQ ID NO: 3171 - protein, 126 aa, Homo sapiens
QVQLVQSGAEVKKPGASVKVSCKASGYTFTNFGISWVRQAPGQGLEWMGWISSYNGNTNYEQKLQGRVTMTTDTSTSTAYMELRSLRSDDTAVYYCARVPPTTYYYTSGSYYCDHWGQGTLVTVSS

SEQ ID NO: 3172 - protein, 107 aa, Homo sapiens
DIQMTQSPSSLSASVGDRVTITCRASQSISSYLNWYHQKPGRAPKLLLYAASTLHSGVPSRFSGSGSGTDFTLTISSLQPEDFATYYCQQSYSTPQTFGQGTKLEIK

SEQ ID NO: 3173 - protein, 121 aa, Homo sapiens
QVQLVESGGGVVQPGRSLRLSCAASGFTFATYAMHWVRQAPGKGLEWVALISHDGSNKHYADSVKGRFTISRDNSKNTLYLQMNSLRAEGTAIYYCARESLEAAAPPFDYWGQGTLVTVSS

SEQ ID NO: 3174 - protein, 107 aa, Homo sapiens; identical to SEQ ID NO: 1062

SEQ ID NO: 3175 - protein, 119 aa, Homo sapiens
EVQLVESGGGLKQPGGSLRLSCVASGFTFSNCAMSWVRQAPGKGLEWVSLIYAAGTSTYYADSVKGRFTISRDNFKNTLYLQMNSLRAEDTAIYYCAKGHISNWYLDNWGQGVLVTVSS

SEQ ID NO: 3176 - protein, 108 aa, Homo sapiens
QIVMTQSPATLSVSLGERVTLSCRASQSVGSNLAWYQQKPGQAPRLLIYGESTRATGVPARFSGSGSGTDFTLTISSLQSEDFAVYYCQQYNQWPPCTFGQGTKLEIK

SEQ ID NO: 3177 - protein, 126 aa, Homo sapiens
QVQLVQSGAEVKKPEASVKVSCKASGYTFTSYDINWVRQATGQGLEWMGWMNPNSGNTGYAQKFQGRVTMTRNTSISTAYMELSSLRSEDTAVYYCARGRYCTGGVCWGDWYFDLWGRGTLVTVSS

SEQ ID NO: 3178 - protein, 108 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNTYSPWTFGQGTKVEIK

SEQ ID NO: 3179 - protein, 126 aa, Homo sapiens
QLQLQESGPGLVKPSETLSLTCSVSGGSIISSSYYWGWIRQPPGKGLEWIGSVFHSGTTYYNPPRKSRVTISVDTSKNQFSLKLTSVTAADTAVYYCVRQSRGSYYDGNNYQILDWGQGTLVIVSS

SEQ ID NO: 3180 - protein, 113 aa, Homo sapiens
DIVMTQSPLSLPVTPGEPASISCRSSQSLLHSDGNNYLDWYLQKPGQSPQLLIYLGSNRASGVPDRFSGSGSGTDFTLKISRVEAEDVGIYYCMQALQTPALTFGGGTKVEIK

SEQ ID NO: 3181 - protein, 131 aa, Homo sapiens
QVQLQESGPGLVKPSQTLSLTCTVSGVSINSGLYYWSWIRQPAGKGLEWIGRIFSDGPSYDTGTTSYNPSLKNRATISLDTSRNQFSLRLSAVTAADTAVYYCAILPDVWGNQGVDNIHPWGQGTMVTVSS

SEQ ID NO: 3182 - protein, 107 aa, Homo sapiens
DIQMTQSPSSLSASVGDRVTITCQASQDINNYLTWYQQKPGKAPKLLIYDASNLETGVPSRFSGTRSGTDFSFIISSLQPEDVATYYCQQYDNLPYTFGQGTKLEIK

SEQ ID NO: 3183 - protein, 122 aa, Homo sapiens
QVHLVQSGAEVKKAGASVKVSCKASGYTFTAYYIHWVRQAPGQGLEWMGWINPSTGGTDYAQNFQGRFTVARDTSISTVYMELSGLRSDDTAIYYCTKEGQRHYIGSWFDPWGQGTLVTVSS

SEQ ID NO: 3184 - protein, 110 aa, Homo sapiens
QSVLTQPPSVSAAPGQKVTISCSGSSSNIGNEYVSWYQQLPGTAPKVLIYDNNKRPSGIPDRFSASKSGTSATLGISGLQTGDEADYYCGTWDTSLTAYVFGTGTKVTVL

SEQ ID NO: 3185 - protein, 126 aa, Homo sapiens
QVQLVESGGGLVKPGGSLTLACAASGFSFSEYYMTWIRQAPGKGPEWVVHISSGGDNVHYADSVTGRFTISRDNAQNSLSLQMTSLRADDSAVYYCARGGRRDLALGPYYYALDLWGQGTTVTVSS

SEQ ID NO: 3186 - protein, 108 aa, Homo sapiens
EIVMTQSPATLSVSPGERATLSCRASQSISNNIAWYQQKPGQAPRLLIYGASTRATGVPARFSGGGSGTEFTLTISSLQSEDFAVYYCQQYNDWPPITFGQGTRLEIK

SEQ ID NO: 3187 - protein, 124 aa, Homo sapiens
EAPLVESGGGLVKPGRSLRLTCRTSGFTFRDFTISWFRQAPGKGLEWVGFIRDPSYGGTTDYAASMRDRFTISRDDSKSIAYLQMDSLKTEDTAVYFCAKRIGYGSGIYVFDQWGQGTLVTVSS

SEQ ID NO: 3188 - protein, 106 aa, Homo sapiens
EIVMTQSPATLSVSPGDRATLSCRASQSVSSDLAWYQQKPGQAPRLLIYGASTRATGIPARFSGSGSGTEFTLTISSLQSEDIAVYYCQQYDDWLSFGGGTKVEIK

SEQ ID NO: 3189 - protein, 120 aa, Homo sapiens
QVQLVQSGGEMKKPGASVKVSCKTSGYNFNSYGVSWVRQAPGQGLEWIGWINAYKGDINYGEGFQGRVALTADALATTVYMELRSLRPDDTAVYYCARDFGYNGYDFDFWGQGTLVTVSS

SEQ ID NO: 3190 - protein, 110 aa, Homo sapiens
IVKLTQPHSVSESPGKTVAISCTASDGSIDSKFVQWLQQRPGSAPKIVIFEDDQRPSGVPERFSASIDRSSNSATLIISGLRTDDEADYYCQSYDGSSRVFGGGTKLTVL

SEQ ID NO: 3191 - protein, 124 aa, Homo sapiens; identical to SEQ ID NO: 671

SEQ ID NO: 3192 - protein, 107 aa, Homo sapiens
DIQMTQSPSSLSASVGDRVTITCQASQDISNYLNWYQQKPGKAPNLLINAASNLKTGVPSRFSGSGSGTYFTFTISSLQPEDIATYYCQQYDNLPLTFGGGTKVEIK

SEQ ID NO: 3193 - protein, 116 aa, Homo sapiens
EVRLLESGGDLVQPGGSLRLSCVASGFTFRGYAMTWVRQAPGKGLEWLAAIYSGGDGPESADSVKGRFIISRDNSKNTLYLQMNSLSVEDTGVYYCAKSSGAFDSWGQGTRVIVTS

SEQ ID NO: 3194 - protein, 107 aa, Homo sapiens
DIQLTQSPSTLSASVGDRVTITCRASQNINSWLAWYRQKPGEAPQLLIYKASTLERGVPSRFSGGGSGTEFTLTISSLQPEDFASFHCQQYSSYPYSFGQGTKLHLD

SEQ ID NO: 3195 - protein, 134 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARNREGIYDFWSGYHRLSYYYYYGMDVWGQGTTVTVSS

SEQ ID NO: 3196 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 3197 - protein, 119 aa, Homo sapiens
QVQLVESGGGLVKPGGSLRLSCAASKFTFSDYYMSWLRQAPGKGLEWISYISGSSGDIYYADSVKGRFTISRDNVRNVLYLQMNSLRVEDTAVYFCARLRRAPWNFDYWGQGTLVTVSS

SEQ ID NO: 3198 - protein, 110 aa, Homo sapiens
QSVLTQPPSASGTPGQTVTISCSGSSSNIGIQTVNWYQQLPGTAPKLLVYSNDQRPSGVPDRFSGSKSGTSASLAISGLQSEDEADYYCAAWDVSLNGPIFGGGTKLTVL

SEQ ID NO: 3199 - protein, 121 aa, Homo sapiens; identical to SEQ ID NO: 1123

SEQ ID NO: 3200 - protein, 112 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGYVVFGGGTKLTVL

SEQ ID NO: 3201 - protein, 128 aa, Homo sapiens; identical to SEQ ID NO: 749

SEQ ID NO: 3202 - protein, 111 aa, Homo sapiens; identical to SEQ ID NO: 1172

SEQ ID NO: 3203 - protein, 135 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHTGYNDEWGSLSFYLGATIQPNYFDYWGQGTLVTVSS

SEQ ID NO: 3204 - protein, 111 aa, Homo sapiens; identical to SEQ ID NO: 1096

SEQ ID NO: 3205 - protein, 121 aa, Homo sapiens
QVHVVQSGAEVKKPGASVKVSCKTSGYTFTGYYIHWVRQAPGQGLEWMGWMNPKSGGTDYAQKFQGRVTLTRDTSTSTVSLELTRLRSDDTAVYFCARGATIGFHDPFDVWGQGTLVTVSS

SEQ ID NO: 3206 - protein, 105 aa, Homo sapiens
DIQMTQSPSTLSASVGDRVTITCRASQSINRWLAWYQQKPGKVPKLLIYKVSTLQSGVPSRFSGSGSGTEFTLTISSLQPDDFATYYCQQYNSFSFGQGTRVEIK

SEQ ID NO: 3207 - protein, 117 aa, Homo sapiens
QVQLVESGGGVVQPGRSLRLSCAASGFTFSSYAMHWVRQAPGKGLEWVALISYDGSNKYYADSVKGRFTISRDNSKNTLYLQMNSLRAEDTAFYYCARDTGGYADYWGQGTLVTVSS

SEQ ID NO: 3208 - protein, 106 aa, Homo sapiens
SYEVTQPPSVSVSPGQTASITCSGDKLGDKYACWYQQKPGQSPVLVMYQDSKRPSGIPERFSGSNSGNTATLTISGTQAMDEADYYCQAWDSSTVVFGGGTKLTVL

SEQ ID NO: 3209 - protein, 120 aa, Homo sapiens
QVQLVESGGGVVQPGRSLRLSCEASGITFSSYNMHWVRQAPGKGLEWVALIWYDGSDKYYADSVKGRFTISRDNSKNTLYLQMNSLRVEDTAIFYCAAAPWDDTSGYDYWGQGTLVTVSS

SEQ ID NO: 3210 - protein, 109 aa, Homo sapiens
EIVLTQSPGILSVSPGERATLSCRASQSVSNTYLAWYQQKPGQAPRLLIYAATNRAPGIPDRFSGSGSGTDFTLTISRLEPEDFATYYCQKYGNSPPITFGPGTKVDIK

SEQ ID NO: 3211 - protein, 126 aa, Homo sapiens
EVQLVDSGGGLVQPGGSLKLSCAASGLNVSGSAMHWVRQTSGKGLEWVGRIRSKIGSYATAYAASVRGRFTISRDDSKNTAYLQMNGLKTEDTAVYYCSSRTIYPSGGRYAVVEYWGQGTLVTVSS

SEQ ID NO: 3212 - protein, 110 aa, Homo sapiens
EIVLAQSPGTLPLSPGDRVTLSCRASQSVSSNYLAWYQQKPGQAPRLLIYAASSRAPGVPDRFSGSGSGTDFTLTISRLEPQDFAMYYCHHYGSSPPAYTFGQGTKLEIK

SEQ ID NO: 3213 - protein, 126 aa, Homo sapiens
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGGQLVRLTLYYYYGMDVWGQGTTVTVSS

SEQ ID NO: 3214 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPATFGQGTKVEIK

SEQ ID NO: 3215 - protein, 121 aa, Homo sapiens
QVQLVQSGAEVKKPGASVKVSCKASGYTFSSYGISWVRQAPGQGLEWMGWISAYNGDTNYAQKLQGRVTMTTDTSTSTAYMELRSLRFDDTAVYYCARDKYYYDSSGYGAWGQGTMVTVSS

SEQ ID NO: 3216 - protein, 107 aa, Homo sapiens
DIQMTQSPSSVSASVGDRVTISCRASQGISSWLAWYQQKPGKAPKLLIYAASSLQSGVPSRFSGSGSGTDFTLTISSLQPEDFATYYCQQANSFPRTFGQGTKVEIK

SEQ ID NO: 3217 - protein, 122 aa, Homo sapiens
EVQLVESGGGLVQPGRSLRLSCAASGFNFHDYAMHWVRQDPGKGLEWVSGINWNSGEIVYADSVKGRFTISRDNAKNSLFLQMNRLKTEDTAFYYCAKDSVVRGVYDSFDFWGQGTMVTVSS

SEQ ID NO: 3218 - protein, 107 aa, Homo sapiens; identical to SEQ ID NO: 3050

SEQ ID NO: 3219 - protein, 137 aa, Homo sapiens
QLQLQESGPGLVNPSETLSLTCTVSGGSISSRSSYWGWGWIRQPPGKGLEWIGNIYYTGSTYDNPSLKSRVTISVDTSKNQFSLQLSSLTAADTAVYYCARLIVVEEAAEVVAAMGGVLPPLGFDPWGQGTLVTVSS

SEQ ID NO: 3220 - protein, 111 aa, Homo sapiens
QSALTQPASVSGSPGQSITISCTGTSTDVGTYNLVSWYQQYPGKAPKLIIYEGSKRPSGVSNRFSGSKSGNTASLTISGLQAEDEADYYCCSYAGSTTFVVFGGGTKLTVL

SEQ ID NO: 3221 - protein, 128 aa, Homo sapiens
EAQLVESGGALVQPGGSLRLSCGASGFTFSRYSFNWVRQAPGKGLEWVAYISRSATSTYYADSVRGRFTISRDNAKRSLYLQMNSLTAEDTAIYYCARDRITMLQGATERGGDGLDVWGPGTTVTVSS

SEQ ID NO: 3222 - protein, 110 aa, Homo sapiens
QSVLTQPPSVSAAPRQRVTISCSGSSSNIGHNAVHWYQQLPGKAPKLLIYYDDLLPSGVSDRFAGSKSGTSASLAISGLQSEDEAQYYCATWDDGLNAVVFGGGTKLTVL

SEQ ID NO: 3223 - protein, 127 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDPASYDFWSGYSGGMFDYWGQGTLVTVSS

SEQ ID NO: 3224 - protein, 109 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPMYTFGQGTKLEIK

SEQ ID NO: 3225 - protein, 121 aa, Homo sapiens
QLQLQESGPGLVKPSETLSLTCTVSGGSVTSVNFYWGWIRQSPGKGLEWIASIYSSGSTYYNPSLKSRVTISLDTSKNRFSLKLNSVTAADTAVYYCARARGGSRGLFDYWGQGTLVTVSS

SEQ ID NO: 3226 - protein, 107 aa, Homo sapiens
DIQMTQSPSTLSASVGDRVTITCRASQSISFWLAWYQQKPGKAPQLLIYKASTLETGVPSRFSGSGSGTEFTLTISSLQPDDFASYYCQQYNSYSGTFGQGTKVEIK

SEQ ID NO: 3227 - protein, 123 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAREGYSYGMVGGYFDLWGRGTLVTVSS

SEQ ID NO: 3228 - protein, 109 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSIVFGGGTKLTVL

SEQ ID NO: 3229 - protein, 128 aa, Homo sapiens
EVQLVQSGAEVKKPGATVKISCKVSGYTFTDYFLHWIQQAPGKGLEWMGLLDPEDGETLYAEKFRGSVTMTADTSTDTAYLQLSSLTSEDTAVYYCATLIVPGFSSGWHNRGYFFDQWGQGTLVTVSS

SEQ ID NO: 3230 - protein, 106 aa, Homo sapiens
EIVMTQSPVTLSVSPGERATLSCRASESVSSKLAWYQQKPGQPPRLLIYGASTRATGIPPRFSGSGSGREFTLTITGLQSEDFAVYYCQPYDDWPLFGQGTRLDIK

SEQ ID NO: 3231 - protein, 123 aa, Homo sapiens
EVQLVESGGGLVQPGRSLRLSCAASGFTFDSYSIHWVRLAPGKGLEWVSGISWNSGNIVYADSVKGRFTISRDNAKNSLYLQMNSLRAEDTALYYCAKAQTSYTSSSRAFDIWGQGTMVTVSS

SEQ ID NO: 3232 - protein, 108 aa, Homo sapiens
QSALTQPASVSGSPGQSITISCTGTSSDIGTYNYVSWYQQHPGKAPKLMIYEVSNRPSGVSNRFSGSKSGNTASLTISGLQAEDEGDYYCSSYTSTYVFGTGTKVTVL

SEQ ID NO: 3233 - protein, 116 aa, Homo sapiens
EVQLVESGGGLVQPGGSLRLSCAASGFTLSSYWMSWVRQAPGKGLEWVANIKQDGSEKYYVDSVKGRFTISRDNAKNSLYLQMNSLRVDDTAVYYCAFTSTAPRYWGQGTLVTVSS

SEQ ID NO: 3234 - protein, 113 aa, Homo sapiens
DIVMTQSPDSLAVSLGERATINCKSSQSVLYGSNSKNYLAWYQQKPGQPPNLLIYWASTRESGVPDRFSGSGSGTDFTLTISSLQAEDVAVYYCQQYYGTPHTFGQGTKVEIN

SEQ ID NO: 3235 - protein, 132 aa, Homo sapiens
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARVSAYYGSGSYYMSGYYYYYGMDVWGQGTTVTVSS

SEQ ID NO: 3236 - protein, 109 aa, Homo sapiens
DIQMTQSPSSLSASVGDRVTITCRASQGISNYLAWYQQKPGKVPKFLIYAASTLQSGVPSRFSGSGSGTDFTLTISSLQPEDVATYYCQKYNSAPPTFTFGPGTKVDIK

SEQ ID NO: 3237 - protein, 125 aa, Homo sapiens
AVQLVESGGGVVHPGGSLRLSCAASGFSVSGNYISWVRQAPGKGPEWVSVIFSAGDTFYADSVKGRFIISRDISQNTVFLQLNNLRAEDTAVYFCARNQSPHRGSNPVYYYFDYWGQGTLVAVSS

SEQ ID NO: 3238 - protein, 108 aa, Homo sapiens
QIVLTQSPATLSLSPGESATLSCRASQSLGSYLAWYQQRPGQAPRLLIYDASRRATGIPARFSGSGSGTDFTLTIRSLEPEDFAVYYCQQGGTWPPYTFGQGTKLEVK

SEQ ID NO: 3239 - protein, 125 aa, Homo sapiens
QVQLVESGGGVVQPGRSLRLSCAASGFTFSSYAMHWVRQAPGKGLEWVAVISYGGTNKYYADSVKGRFTISRDNSKNTLYLQMNSLRAEDTAVYYCAKDPAYDFWSGYQALFDYWGQGTLVTVSS

SEQ ID NO: 3240 - protein, 106 aa, Homo sapiens; identical to SEQ ID NO: 712

SEQ ID NO: 3241 - protein, 128 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARLPRSYYDSSGYYNRAFDIWGQGTMVTVSS

SEQ ID NO: 3242 - protein, 108 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSVVFGGGTKLTVL

SEQ ID NO: 3243 - protein, 122 aa, Homo sapiens
EVQLLESGGGLAQPGGSLRLSCAASGFTFSSYSMSWVRQAPGKGLEWVSVISGSGGSTYYADSVKGRFTISRDNSKNTLYLQMNSLRAEDTAVYYCAKISRELVTRAYFGYWGQGTLVTVSS

SEQ ID NO: 3244 - protein, 107 aa, Homo sapiens
EIVLTQSPATLSLSPGERATLSCRASQSVSNYLAWYQQKPGQAPRLLIYDASNRATGIPARFSGSGSGTDFTLTISSLEPEDFAVYYCQQRSNWPLTFGGGTKVEIK

SEQ ID NO: 3245 - protein, 120 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQGVMKYGMDVWGQGTTVTVSS

SEQ ID NO: 3246 - protein, 108 aa, Homo sapiens; identical to SEQ ID NO: 740

SEQ ID NO: 3247 - protein, 125 aa, Homo sapiens
EVQLVESGGGFVQPGGSLRVSCAASGFIFSRFRMHWVRQAPGKGLVWVSRIESDGTSSTYADSVKGRFTISRDNAKNTLYLQMNSLRTDDTAVYFCARDYYDSPGDPQYNWFDPWGQGTLVTVSS

SEQ ID NO: 3248 - protein, 109 aa, Homo sapiens
SYELTQPPSVSVSPGQPARITCSGDALAKKYAYWYQQKSGQAPVLVIYEDSKRPSGIPERFSGSSSGTLATLTITGAQVEDEADYYCYSTDSSGSHRGIFGTGTKVTVL

SEQ ID NO: 3249 - protein, 126 aa, Homo sapiens
QVQLVRSGAEVKKAGASVKVSCKASGYTFTSYGISWVRQAPGQGLEWMGWISAYNGNTNYAQKLQGRVTMTTDTSTSTAYMELRSLRSDDTAVYYCARMLIAAAGTSRDYYSMDVWGQGTTVTVSS

SEQ ID NO: 3250 - protein, 108 aa, Homo sapiens; identical to SEQ ID NO: 758

SEQ ID NO: 3251 - protein, 129 aa, Homo sapiens
EVQLLESGGGLVQPGGSLRLSCAASGFTFSSYAMSWVRQAPGKGLEWVSVIYSGGSSTYYADSVKGRFTISRDNSKNTLYLQMNSLRAEDTAVYYCAKDLVGIAVAGTDYYYYYGMDVWGQGTTVTVSS

SEQ ID NO: 3252 - protein, 109 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSVTYRWVFGGGTKLTVL

SEQ ID NO: 3253 - protein, 126 aa, Homo sapiens
QVQLVQSGAEVREPGTSVKVSCKASGGTFTRYTLSWLRQAPGQGLEWMGRIIPVHDISNYAQKFQGRVTITADKSTNTAYMELSSLRSEDTAVYYCARGGDYYDRSDFYYNYFDPWGQGTVVTVSS

SEQ ID NO: 3254 - protein, 110 aa, Homo sapiens
QSALTQPASVSGSPGQSITISCTGTSSDVGTYNLVSWYQQRPGKAPELMIYEGTKRPSGISNRFSGSKSGNTASLTISGLQAEDEAEYYCCSYASSRSFVFGTGTKVTVL

SEQ ID NO: 3255 - protein, 132 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDLARDYDFWSGYYTRYYYYGMDVWGQGTTVTVSS

SEQ ID NO: 3256 - protein, 112 aa, Homo sapiens
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLPHTFGQGTKLEIK

SEQ ID NO: 3257 - protein, 119 aa, Homo sapiens
QVQLVESGGGVVQPGTSLRLSCKASGFFFSENGMHWVRQAPGKGLEWVAVIWHDGITQYNGDSVKGRFTISRDNSRSTLYLQMHSLRGEDTAIYFCAKSRDGYNHGLSWGQGTLVHVSL

SEQ ID NO: 3258 - protein, 112 aa, Homo sapiens
GVVMTQSPLSLSVTPGETASISCRSSQSVMHSNGNNYVDWYLQKPGQSPQLLIYFGSKRASGVPDRLSGRESGTDFTLEISRVEAEDVGIYYCMQALNVPLTFGGGTKVEIR

SEQ ID NO: 3259 - protein, 120 aa, Homo sapiens
QVQLEESGPGLVKPSETLSLTCTVSDFSISTDYYWGWIRQPPGKGLEWIASIYHSGNIYFSPSLKSRVTLSVDTSKNQFSLSLTSVTAADTAIYYCARDVRRNSSGFDFWGRGTLVAVSS

SEQ ID NO: 3260 - protein, 108 aa, Homo sapiens
DVHLTQSPSSLSASVGDRVTLTCRASRDIRTYLQWYQQRPGRAPKLLISSASTLRNGVPSRFSGSGSGTDFTLTISGLQPEDFATYYCQQTYSTPAWTFGPGTKVEIK

SEQ ID NO: 3261 - protein, 122 aa, Homo sapiens
EEQALESGGGLVQPGGSLRLSCAVSGFTLSSHAMSWVRQAPGKGLEWVSLINSDESTIHYADSVKGRFTISRDSSKKTLYLQMNSLRVEDTAVYHCARTYSSSWGGDALDIWGPGTMVTVSS

SEQ ID NO: 3262 - protein, 111 aa, Homo sapiens
QSALTQPASVSGSPGQSITISCTGAASDIGGYNYVSWYQVHPGKVPKLIIYDVSDRPSGVSNRFSGSKSGNTASLTISGLQAEDEADYYCSSYTSRSTLGVFGGGTKLTVL

SEQ ID NO: 3263 - protein, 125 aa, Homo sapiens
QLQLQESGPRLVRPSETLSLKCSVSGVSLGHSDSQWGWIRQTPEKGLEYIGNIHRLGPTTSYNPSLKNRLTIALDMSTNHFSLRLTSVSAADTALYFCARGARTANYPDWFFDVWGRGTPVTVSS

SEQ ID NO: 3264 - protein, 107 aa, Homo sapiens; identical to SEQ ID NO: 776

SEQ ID NO: 3265 - protein, 118 aa, Homo sapiens
QVQLQESGPGLVKPSETLSLTCTVSGYSISSGYYWGWIRQPPGKGLEWIGSIYHSGSTYYNPSLKSRVTISVDTSKNQFSLKLSSVTAADTAVYYCARGPSSSWPDYWGQGTLVTVSS

SEQ ID NO: 3266 - protein, 110 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNWVFGGGTKLTVL

SEQ ID NO: 3267 - protein, 121 aa, Homo sapiens
EEQLVQSGPEVKKAGESLKISCQGSGYPFTSHWIGWVRQMPGQGLEWMGIIYPGDSDTRYSPSFQGQVTISADKSLSTAYLQWTSLKASDTGMYYCARHYGGDPYWYFDLWGRGTLVAVSS

SEQ ID NO: 3268 - protein, 109 aa, Homo sapiens
DIVLTQSPGTLSLSPGERATLSCRASQSVGSSYLAWYQQKPGQAPRLLIYHVSSRATGIPDRFSGSGSGTDFTLTISRLEPEDFAVYYCQQYGNSAMYTFGQGTKVEIK

SEQ ID NO: 3269 - protein, 119 aa, Homo sapiens
QVTLRESGPALVKPTQTLTLTCTFSGFSLNTRGMCVSWIRQPPGKALEWLARIDWDDDKYYSTSLETRLTISKDSSKNQVVLTMTNMDPVDTATYYCARMVVTTGIDYWGQGTLVTVSS

SEQ ID NO: 3270 - protein, 107 aa, Homo sapiens
DIQMTQSPSSLSASVGDRVTITCRASHSISRYLNWYQQKPGKAPNLLIFAASSLQSGVPSRFSGSGSGTDFTLTISSLQPEDFATYYCQQSYSTPYTFGQGTKLESK

SEQ ID NO: 3271 - protein, 117 aa, Homo sapiens
EVQLVESGGGLVQPGGSLRLSCAASGITVSRNYMSWVRQAPGKGLEWVSVIYSGGSTFYSDSVKGRFTISRDNSKNTLYLQMNSLRAEDTAVYYCARSIADDAFDIWGQGTMVTVSS

SEQ ID NO: 3272 - protein, 108 aa, Homo sapiens
DIQLTQSPSFLSASVGDRVTITCRASQGISSYLAWYQQKPGKAPKLLIYAASTLQSGVPSRFSGSGSGPEFTLTISSLQPEDFATYYCQQLNSYPPGTFGQGTKVEIE

SEQ ID NO: 3273 - protein, 123 aa, Homo sapiens
RVELVQSGAEVKKPGASLKVSCKTSGYAFPSYYIHWVRQAPGHGLEWMGAINPSGGTTTFAPKFQGRLSMTSDTSTSIVYIDLNNLRPEDTAVYFCAGYSSDWQSHNDGLDVWGQGTRVTVSS

SEQ ID NO: 3274 - protein, 107 aa, Homo sapiens
EVVLTQSPDFQSVIPKETVTITCRATQSIGSSLHWYQQKPGQSPKLLIKYASQSFSGVPSRFSGSGSGSDFTLTINSLEAEDAATYYCHQTTTLPYTFGQGTKLEIK

SEQ ID NO: 3275 - protein, 120 aa, Homo sapiens
QITLKESGPTLVKPTQTLTLTCTFSGFSLSTNGVGMGWIRQPPGKALEWLALIYWDDDQFYSPSLKSRLTITRDTSKNQVVLTMTNMDPVDTATYYCAQAFYESFGFYSWGQGTLVTVSS

SEQ ID NO: 3276 - protein, 111 aa, Homo sapiens
NFMLTQPHSVSESPGKTVIISCTRSIGSIASNYVQWYQQRPGSAPTIVVFEDNERPSGVPDRFSGSIDRSSNSASLTISGLKTEDEADYYCQSYDGSSELVFGGGTKLTVL

SEQ ID NO: 3277 - protein, 119 aa, Homo sapiens
QVQLVQSGSELKKPGASVKVSCKASGYTFTTYAMNWVRQAPGQGLEWMGWINTNTGNPTYAQGFTGRFVFSLDTSVSTAYLQISSLKAEDTAVYYCAREVDSSGFFPPWGQGTLVTVSS

SEQ ID NO: 3278 - protein, 108 aa, Homo sapiens
SYELTQPPSVSLSPGQTARITCSGDTLPKQYAFWYQQKPGQAPVLVIYKDSERPSGIPERFSGSSSGTTVTLTISGVQAEDEADYYCQSADSSSTSWVFGGGTKLTVL

SEQ ID NO: 3279 - protein, 121 aa, Homo sapiens
QVQLQESGPGLVKPSQTLSLTCTVSGGSISSGGYFWSWIRQHPGKGLEWIGHIYHSGSTYYNPSLKSRVTISVDTSKNQFSLKLSSVTAADTAVYYCAREKMSSSSDFDYWGQGTPVTVSS

SEQ ID NO: 3280 - protein, 109 aa, Homo sapiens
EIVMTQSPATLSVSPGERATLSCRASQSVSSNLAWYQQKPGQAPRLLIYDASTRATGIPARFSGSGSGTEFTLTISSLQSEDFAVYYCQQYNNWPPIRTFGQGTKVEIK

SEQ ID NO: 3281 - protein, 127 aa, Homo sapiens
QLQLQESGPGLVKPSETLSLTCTVSGGSISSSTYYWGWIRQPPGKGLEWIGSIFYSGRTYYNPSLKSRVTISVDTSKNQFSLNLRFVNAADTAVYYCASPFAAAGPPLWYYYGMDVWGQGTTVTVSS

SEQ ID NO: 3282 - protein, 112 aa, Homo sapiens
QSVLTQPPSASGTPGQRVTISCSGSSSNIGSNTVNWYQQLPGTAPKLLIYRNNQRPSGVPDRFSGSKSGTSASLAISGLQSEDEADYYCAAWDDTLSGPNWVFGGGTKLTVL

SEQ ID NO: 3283 - protein, 121 aa, Homo sapiens
QVQLVESGGGVVQPGRSLRLSCAASGFTFSTYAMHWVRQAPGKGLEWVAVISYDGTNKYYADSVKGRFTISRDNSKNTLYLQMNSLRAEDTAVYYCARTYGGNYLGYFDYWGQGTLVTVSS

SEQ ID NO: 3284 - protein, 107 aa, Homo sapiens
EMVMTQSPATLSVSPGERATLSCRASQSVSSKLAWYQQKPGQGPRLLIYGASTRAAGIPARFSGSGSGTEFTLTISSLQSEDFAVYFCQQYNNWPLTFGGGTTVEIK

SEQ ID NO: 3285 - protein, 123 aa, Homo sapiens
QVQLVQSGAEVKKPGASVKVSCKVSGYTLIELSMHWVRQAPGKGLEWMGGFDPEDGETIYAQKFQGRVTMTEDTSIDTAYMELSGLRSEDTAVYYCATAPPMGRSRTNWFEVRGQGTLVSVSS

SEQ ID NO: 3286 - protein, 110 aa, Homo sapiens
QSVLTQPPSASGTPGQRVTISCSGSSSNIGTNTVNWYQQLPGTAPKLLIYSNNQRPSGVPDRFSGSKSGTSASLAISGLHSEDEADYFCAAWDDSLNGWVFGGGTKLTVL

SEQ ID NO: 3287 - protein, 130 aa, Homo sapiens
QVQLVESGGGVVQPGRSLRLSCAASGFTFSSSAMHWVRQAPGKGLEWVAVISYDGSDTYYADSVKGRFTISRDNSKNTLYLQMNSLRDEDTAVYYCARDEAETSLGGWVKPMINWYFDLWGRGTLVTVSS

SEQ ID NO: 3288 - protein, 107 aa, Homo sapiens
DIQMTQSPSSLSASVGDRVTITCRASQGISNYLAWFQQKPGKAPKSLISAASRLQSGVPSKFSGSGSGTDFTLTISSLQPEDFATYYCQQYHSYPPTFGQGTRLEIK

SEQ ID NO: 3289 - protein, 122 aa, Homo sapiens
QVHLQESGPGLVKPSGTLSLTCAVSGGSISSSNWWSWVRQPPGKGLEWIGEIYHSGSTDYNPSLKSRVTISVDKSKNQFSLKLSSVTAADTAVYYCARRFFYNWNDHGMDVWGQGTTVTVSS

SEQ ID NO: 3290 - protein, 108 aa, Homo sapiens
SSELTQDPAVSVALGQTVRITCQGDSLRSYYASWYQQKPGQAPVLVIHAKNNRPSGIPDRFSGSSSGNTASLTITGAQAEDEADYYCNSRDSSSYHQVFGGGTKLTVL

SEQ ID NO: 3291 - protein, 125 aa, Homo sapiens
QVQLQESGPGLVKPSETLSLTCTVSGGSISSYYWSWIRQPPGKGLEWIGYIFHSGSTNYNPSLKSRVTISLDMSKNQFSLNLSSVTAADTAVYYCATQEYSSSSALGYYYGLDVWGQGTTVTVSS

SEQ ID NO: 3292 - protein, 106 aa, Homo sapiens
SYELTQPPSVSVSPGQTASITCSGDKLGDKYACWYQQKPGQSPVLVIYQDTKRPSGIPERFSGSNSGNTATLTISGTQAMDEADYYCQAWDSNTAVFGGGTELTVL

SEQ ID NO: 3293 - protein, 124 aa, Homo sapiens
EVQLVESGGGLVQPGGSLRLSCAASGFTFSIYWMSWVRQAPGKGLEWVANIKQDGSEKYYVDSVKGRFTISRDNAKNSLYLQMNSLRAEDTAVYYCARDRQRSGSYNPYAMDVWGQGTTVTVSS

SEQ ID NO: 3294 - protein, 112 aa, Homo sapiens
DIVMTQSPLSLPVIPGEPASISCMSSQSLLHSNGYNYLDWYLQKPGQSPQLLIYLGSNRASGVPDRFSGSGSGTDFTLKISRVEAEDVGVYYCMQALQTPWTFGQGTKVEIK

SEQ ID NO: 3295 - protein, 128 aa, Homo sapiens
QVHLVQSGAEVKKPGASVKVSCKVSGYTLTELSMHWVRQAPGKGLEWMGGFDPEDGETIYAQKFQNRVTMTEDTSTDTAYMELSSLTSEDTAVYYCATETPYSSTWYVLPNYYGMDVWGQGTTVTVSS

SEQ ID NO: 3296 - protein, 110 aa, Homo sapiens
QAGLTQPPSLSKGLRQTATLTCTGNSNNVGNQGAVWLQQHQGHPPKLLSYKNNSRPSGISERLSASRSGNTASLTITGLQPEDEADYYCSAWDSSLSAWVFGGGTKLTVL

SEQ ID NO: 3297 - protein, 118 aa, Homo sapiens
QVQLQESGPGLVKPSETLSLTCTVSGGSINNYYWSWIRQAPGKGLEWIGYIYYSGSTNYNPSLKSRVSISLDTSKNQFSLKLSSVTAADTAVYYCARDRLFSSYFDYWGQGTLVTVSS

SEQ ID NO: 3298 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPLYTFGQGTKLEIK

SEQ ID NO: 3299 - protein, 122 aa, Homo sapiens
QVQLEQSGAEVKKPGASVKVSCKVSGYTLPEIAIHWVRQAPGKGLEWMGGFDPEDAETIYAQKFQGRVTMTEDTSTDTAYMELSSLRSEDTAVYYCAGASPLVSGINWFDPWGQGTLVTVSS

SEQ ID NO: 3300 - protein, 110 aa, Homo sapiens
QSVLTQPPSESAAPGQKVTISCSGSSSNIGNNYVSWYRQLPGTAPKLLIYDNNKRPSGIPDRFSGSKSGTSATLGITGLQTGDEADYYCGTWDSSLSDYVFGTGTKVAVL

SEQ ID NO: 3301 - protein, 128 aa, Homo sapiens
QVPLQESGPGLVKPSQTLSLTCTVSGGSISSGSYYWSWIRQPAGKALEWIGHIYTSGSTNYNPSLKSRVTISVDTSKNQFSLKLSSVTAADTAVYYCAREWGFWYAYDSGSFWYFDYWGQGTLVTVSS

SEQ ID NO: 3302 - protein, 108 aa, Homo sapiens
DIQMTQSPSTLSASVRDRVSITCRASQSISSWLAWYQQKPGKAPKVMIYKASSLESGVPSRFSGSGSGTEFTLTISSLQPDYFATYYCQQYESYPMYTFGQGTKLEIK

SEQ ID NO: 3303 - protein, 120 aa, Homo sapiens
QVQLVESGGGVVQPGRSLRLSCAASGFTFNSYAMHWVRQAPGKGLEWVAVISYDGDNKYYADSVNGRFTFSRDNSKNALYLQMNSLRPEDTAVYYCARGGGNYFTYFDYWGQGTLVTVSS

SEQ ID NO: 3304 - protein, 108 aa, Homo sapiens
EIVMTQSPATLSVSPGERATLSCRASQSVNSKLAWYQQRPGQAPRLLIYGASTRATGIPARFSGSGSGTEFTLTISSLQSEDFAVYYCQQYNSWPPNTFGQGTKLEIK

SEQ ID NO: 3305 - protein, 121 aa, Homo sapiens
QVQLVESGGGVVQPGRSLRLSCAASGFTFSHYGMHWVRQAPGKGLEWVAVIWYDGTKKYYADSVKGRFTISRDNSKNTLYLQMNSLGAEDTAVYYCARSKWLQIRAGCDYWGQGTLVTVSS

SEQ ID NO: 3306 - protein, 112 aa, Homo sapiens
DIVMTQNPLSLSVTPGQPASISCKSSQSLLHSDGKTYLYWYLQKPGQPPQLLIYEVSNRFSGVPDRFSGSGSGADFTLKISRVEAEDVGIYYCMQSIQLPLTFGGGTKVEIK

SEQ ID NO: 3307 - protein, 118 aa, Homo sapiens
EVQLLESGGGLVQPGGSLRLSCAASGFLVNDYAMGWVRQAPGKGLEWVSAISGSGLSRTFYADSVRGHLTISRDNSRNTLYLQMSSLRAEDTAIYYCATRDTTKMIHWGQGTLVTVSS

SEQ ID NO: 3308 - protein, 107 aa, Homo sapiens
DVQMTQSPSSLSASVGDRVTITCRASQDIDNVLAWYQQKPGKRPKLLIYTASTLQLGVPSRFRGSGSGTDFTLTISSLQPEDIGTYYCQKYDGAPWTFGQGTKVEIK

SEQ ID NO: 3309 - protein, 128 aa, Homo sapiens
EVQLVESGGGLVQPGRSLRLSCAASGFSFDDYAMHWVRQAPGKGLEWVSGMSWNSGTRGYADSVKGRFTISRDNAKNSLYLQMNSLRPEDTALYYCVKAYCGGDCYSLVFASDAFDIWGQGTMVTVSS

SEQ ID NO: 3310 - protein, 110 aa, Homo sapiens
QSVLTQPPSVSAAPGQKVTISCSGSSSNIGNNFVSWYQQFPGTAPKLLIYDNNKRPSGIPDRFSGSTSGTSATLGITGLQTGDEADYYCGTWDSSLSAGVFGGGTKLTVL

SEQ ID NO: 3311 - protein, 132 aa, Homo sapiens
QVQLVESGGGVVQPGRSLRLSCAASGFTFSSYGMHWVRQAPGKGLEWVAVIWYDGSDKYYADSVKGRFTISRDNSKNTLYLLMNSLRAEDTAVYYCARDGMEKYCSGGSCYFTQVAYYFDYWGQGTLVTVSS

SEQ ID NO: 3312 - protein, 107 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQCSNWPPTFGQGTKVEIK

SEQ ID NO: 3313 - protein, 122 aa, Homo sapiens
QVQLVQSGSELKKPGASVKVSCKASGYTFTTYAMNWVRQAPGQGLEWMGWINTNTGDPTYAQGFTGRFVFSLDTSVNTAYLQISSLKAEDTAVYYCARPNFSGWYSSAFDIWGQGTMVTVSS

SEQ ID NO: 3314 - protein, 108 aa, Homo sapiens
EIVMTQSPANLSVSPGDRATLSCRASQSVYSNLAWYQQKPGQAPRLLIYGASTRATGIPARFSGSGSGTEFTLTISSLQSEDFAVYYCQQYYNWPRWTFGQGTKVEIK

SEQ ID NO: 3315 - protein, 117 aa, Homo sapiens
EVQLVESGGGLVQPGGSLRLSCAASGLTVSSNYMSWVRQAPGKGLEWVSIIYSGGTTYYADSVKGRFTISRDTSKNTLYLQMNSLRAEDTAVYYCARDVMVRGVMDWGQGTLVTVSS

SEQ ID NO: 3316 - protein, 109 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNDWPPRYTFGQGTKLEIK

SEQ ID NO: 3317 - protein, 123 aa, Homo sapiens
EVQLVESGGGLVQPGGSLRLSCTASGFTFSRYDMHWVRQATGKGLEWVSAIGTAGDTYYPGSVKGRFTISRENAKNSLYLQMNSLRAGDTAVYYCARAPRDYHILTSGAFDIWGQGTMVTVSS

SEQ ID NO: 3318 - protein, 108 aa, Homo sapiens
EIMMTQSPATLSVSPGERATLSCRASQSVNSNLAWYQQKPGQAPRLLLYGASTRATGIPGRFSGSGSGTEFTLTISSLQSEDFAVYYCQQYHNWPPLTFGGGTKVEIK

SEQ ID NO: 3319 - protein, 127 aa, Homo sapiens
EVHLVESGGGLVKPGGSLRLSCAASGFTFSNYGMNWVRQAPGKGLEWVSSISSSSNFIYVADSLKGRFTISRDNGKNSLYLQMNSLRAEDTAVYYCARDERLYDFLTDYYKGPLDYWGQGTLVTVSS

SEQ ID NO: 3320 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYYNWPPWTFGQGTKVEIK

SEQ ID NO: 3321 - protein, 121 aa, Homo sapiens
QVQLVESGGTVVQPGKSLRLSCAASGFIFSTYAINWVRQAPGKGLEWVAVISYDGNNKYYADSVKGRFTISRDNSKNTVFLQMNSLRAEDTAMYYCARPRGGGYRDAFDIWGQGTMVTVSS

SEQ ID NO: 3322 - protein, 107 aa, Homo sapiens
DIQMTQSPSTLSASVGDRVTITCRASQSISTWLAWYQQKPGKAPKLLIYKASSLEGGVPSRFSGSGSGTEFTLTISSLQPDDFATYYCQQYNTYPWTFGQGTKVEIK

SEQ ID NO: 3323 - protein, 119 aa, Homo sapiens
QVQLQESGPGLVKPSGTLSLTCAVSGGSISSSNWWSWVRQPPGKGLEWIGEIYHSGNTNYNPSLKSRVTTSVDKSKNQISLRLSSVTAADTAVYFCARRMVQGGGLDYWGQGTLVTVSS

SEQ ID NO: 3324 - protein, 110 aa, Homo sapiens
QSALTQPASVSGSPGQSITISCTGTSSDVGSYNLVSWYQQHPGKAPKLMIYELSKRPSGVSNRFSGSKSGNTASLTISGLQADDEADYYCWSYAGFSSWVFGGGTKLTVL

SEQ ID NO: 3325 - protein, 116 aa, Homo sapiens
EVQLVESGGGLVQPGGSLRLSCAASGFTVSSNYMNWVRQAPGKGLEWVSVIYSGGSTYYADSVKGRFTISRHNSKNTLYLQMNSLRAEDTAVYYCARDAYHYGEDWGQGTLVTVSS

SEQ ID NO: 3326 - protein, 112 aa, Homo sapiens
QLVLTQSPSASASLGASVKLTCTLSSGHSSSAIAWLQQQPEKGPRYLMNVNSDGSHSKGDGIPDRFSGSSSGAERYLTISSLQSEDEADYYCHTWGTDIHWVFGGGTKLTVL

SEQ ID NO: 3327 - protein, 120 aa, Homo sapiens
EVQLVESGGDLVQPGGSLRLSCAASGFSFSVYGMHWVRQAPGKGLEYVSGISTNGDSTYYANSVKGRFTISRDKSKNTLFLQMGNLRAEDMAIYYCATTTPAPGDYFDYWGQGTLVTVSS

SEQ ID NO: 3328 - protein, 109 aa, Homo sapiens
SYVLTQPPSVSVAPGKTARITCGGNNIGSKSVHWYQQTPGQAPVLVIYYDNDRPSGIPERFSGSNSGNTATLTISRVEAGDEADYYCQVWDSSSDPHYVFGTGTKVTVL

SEQ ID NO: 3329 - protein, 122 aa, Homo sapiens
EVQLVESGGGLVKPGGSLRLSCAASGFNFNSFGMNWVRQAPGKGLEWVSFISSSSSFIYYADSVKGRFSISRDNAKNSLYLQMNSLRAEDTAVYYCARDPHNYFGSGSSDYWGQGTLVTVSS

SEQ ID NO: 3330 - protein, 108 aa, Homo sapiens
EIVMTQSPATLSVSPGERVTLSCRASQSVSSNLAWYQQKPGQAPRLLIFGASTRATGIPARFSGSGSGTEFTLTISSLQSEDFAVYYCQQYYNWPPWTFGQGTKVDIK

SEQ ID NO: 3331 - protein, 121 aa, Homo sapiens
QVQLVESGGGVVQPGRSLRLSCAASGFTFSSYGMHWVRQAPGKGLKWVAVIWYDGSNKYYADSVKGRFTISRDNSKNTVYLQMSSLRADDTAVYFCAREGIYGDYTGIDYWGQGTLVTVSS

SEQ ID NO: 3332 - protein, 109 aa, Homo sapiens
SYELTQPPSVSVSPGQTARITCSGDALPKKYAYWYQQKSGQAPVLVIYEDSRRPSGIPERFSGSSSGTMATLTISGAQVEDEADYYCYSTDSSDNHKWVFGGGTKLTVP

SEQ ID NO: 3333 - protein, 122 aa, Homo sapiens
EVQLLESGGGLVQSGGSLRLSCAASGFTFSSYAMSWVRQAPGKGLEWVSSIVGSGGRTNYADSVKGRFTISRDNSKNTLYLQMNTLRAEDTAVYFCAKDCSSCYASGGFDCWGQGTLVTVSS

SEQ ID NO: 3334 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYDNYPWTFGPGTKVEIK

SEQ ID NO: 3335 - protein, 121 aa, Homo sapiens
QVQLVQSGAEVKKPGTSVKVSCKASGYTFTSYYMHWVRQAPGQGLEWMGIINPSGGGTSNAQKFQGRVTMTRDTSTSTVYMELSSLRSEDTAVYYCARDSYYGAGSLFGYWGQGTLVTVSS

SEQ ID NO: 3336 - protein, 107 aa, Homo sapiens
DIQMTQSPSSLSASVEDRVTITCRANQSISNYLNWYQQKPGKGPKLLIYAASSLQSGVPSRFSGSGSGTDFTLTISSLQPEDFATYYCQQSYSTPPTFGQGTRLEIK

SEQ ID NO: 3337 - protein, 117 aa, Homo sapiens
EVELVESGGGLVQPGGSLRLSCVASGFTFSSSWMAWFRQAPGKGLEWVADINQDASSQYYVDSVQGRFTISRDNAKNSVFLQMNSLRVDDTAVYFCATIRAYCSHSWGQGILVTVSS

SEQ ID NO: 3338 - protein, 110 aa, Homo sapiens
QSALTQPPSASGSPGQSVTISCTGTSRDVGRYDFVSWYQQHPGKAPKVMIFEVNKRPSGVPDRFSGSKSGNTASLTVSGLQFEDEADYYCSAHAGNTHVIFGGGTKLTVL

SEQ ID NO: 3339 - protein, 129 aa, Homo sapiens
QVQLVQSGAEVKKPGASVKVSCKVSGYTLVELSMHWVRQAPGKGLEWMGGFDPEAGETIYAQKFQGRVTMTEDTSTDTAYMELSSLRSEDTAVYYCATGPPTLTDYYGSRVLLGWFDPWGQGTLVTVSS

SEQ ID NO: 3340 - protein, 109 aa, Homo sapiens
EIVLTQSPGTLSLSPGERATLSCRASQSVTSNYLAWYKQKPGQAPRLLIYGASSRATGIPDRFSGSGSGTDFTLTISRLEPEDFAVYYCQQYGSSPLYTFGQGTKLEIR

SEQ ID NO: 3341 - protein, 120 aa, Homo sapiens
EVQLLESGGGLVQPGGSLRLSCAASGFTFSSYVMNWVRQAPGTGLEWVSGISGSGGASYSADSVKGRFTISRDNSKNTLYLQMDSLRAEDTALYYCAKPRGGNPFDFDYWGQGTLVTVSS

SEQ ID NO: 3342 - protein, 112 aa, Homo sapiens
DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYSWYTFGQGTRLEIK

SEQ ID NO: 3343 - protein, 118 aa, Homo sapiens
QVQLQESGPGLVKPSETLSLTCTVSGGSISSYYCSWLRQPPGKGLEWIGHISYDGTTNYSPSLKSRVTLSVDTSKKQISLHLSSVTAADTAVYYCARSRYRSSLIDNWGQGSLVTVSS

SEQ ID NO: 3344 - protein, 110 aa, Homo sapiens
QSGLTQPPSVSGTPGQRVTISCSGSSSNIGRYPVNWYQHVPGTAPKLLIYSNNQRPSGVPDQFSGSKSGTSASLAISGLQSEIEADYYCAAWDESLDAVVFGGGTKLTVL

SEQ ID NO: 3345 - protein, 119 aa, Homo sapiens
QVRLVESGGGVVQPGRSLRLSCVASGLTFSDYAMHWVRQAPGKGLEWLALIASDGSNKYYADSLEGRLTISRDNSNNTVYLQMDSLRPEDTAFYYCATEVWYSTRTSWWGQGILVSVSS

SEQ ID NO: 3346 - protein, 108 aa, Homo sapiens
EIVMTQSPATVSVSPGERVTLSCRASQSVSTNLAWYQQKPGQAPRLLIFGASTRATDIPARFSGSGSGTEFSLTINSLQSEDFAVYYCQEYKNWLTWTFGQGTKVEIK

SEQ ID NO: 3347 - protein, 119 aa, Homo sapiens
QVQLVESGGGVVQPGRSLRLSCAASGFTFSTYAMHWVRQAPGKGLEWVAVISYDGSNKYYADSVRGRFTISRDNSKNTLYLQMNSLRPEDTAVYYCARASSAYYYFDYWGQGTLVTVSS

SEQ ID NO: 3348 - protein, 106 aa, Homo sapiens
EIVLTQSPATLSLSPGERATLSCRASQSVSSYLAWYQQKPGQAPRLLIYDASYRATGVPARFSGSGSGTDFTLTISSLEPEDFAVYYCQQRRNSLTFGGGTKVEIK

SEQ ID NO: 3349 - protein, 126 aa, Homo sapiens
QDQLVQSGAEVKKPGSSVRVSCKASGDTSKNYAITWVRQAPGQGLEWVGRIIPLLGVTNYAQKFQGRVTITADKSTRTAYMEVNTLRPEDSAVYYCARRTYPSLSTVYYYHGMDVWGQGTTVTVSS

SEQ ID NO: 3350 - protein, 111 aa, Homo sapiens
EIVMTQSPLSLPVTPGESASISCRSSQSLLHGDGHNYLDWYVQKPGQPPQLLIYLGSSRASGVPDRFSGSGSGTDFTLKISRVEADDVGVYYCMQSRQTVTFGGGTKVEIK

SEQ ID NO: 3351 - protein, 124 aa, Homo sapiens
EVQLVESGGGLVQPGGSLRLSCAASGFTFSRYWMNWVRQAPGKGLEWVANIDQDASEKYYVDSVQGRFTISRDNAKNSLYLQMNSLRAEDTAVYYCARDPEDVYGDYGGMNDYWGQGTLVTVSS

SEQ ID NO: 3352 - protein, 107 aa, Homo sapiens
AIRMTQSPSSFSASTGDRVTITCRASQGISSYLAWYQQKPGKAPKLLIFGESTLHSGVPSRFSGSGSGTDFTLTISRLQSEDFATYYCQQYYSYPLTFGQGTKVEIK

SEQ ID NO: 3353 - protein, 125 aa, Homo sapiens
QVQLQESGPGLVKPSGTLSLTCAVSGGSISSSNWWSWVRQPPGKGLEWIGEIYHSGSTNFNPSLKSRVTLSVDKSKNRFSLKLTSVTAADTAVYYCARMRYYYGSGNYPYYFDYWGQGTLVTVSS

SEQ ID NO: 3354 - protein, 108 aa, Homo sapiens
QSVLTQPPSVSGAPGQRVTISCTGSSSNIGAGYDVHWYQQLPGTAPKLLIYDNNIRPSGVPDRFSGSQSGTSASLAITGLQAEDEADYYCQSYDSSVIFGGGTKLTVL

SEQ ID NO: 3355 - protein, 123 aa, Homo sapiens
QLQLQESGPGLVKPSETLSLTCTVSGGSISSSNYYWGWIRQPPGKGLEWIGNIYYSGISYYNPSLKSRVTMSVDTSKNQFSLKLNSVTAADTAVYYCARTIDSVNYYNVLDYWGQGTLVTVSS

SEQ ID NO: 3356 - protein, 107 aa, Homo sapiens
DIQMTQSPSSLSASVGDRVTITCRASQGIRNDLGWFQQKPGNAPKRLIYTASSLQSGVPSRFSGSGSGTEFTLTISSLQPEDFATYYCLQHNSYPLTFGGGTKVEIK

SEQ ID NO: 3357 - protein, 120 aa, Homo sapiens
EVQLVESGGGLVQPGGSLRLSCAASGFTFSSYDMHWVRQVPGKGLDWVSTIGTAGDTYYPGSVKGRFTISRENAKNSLYLQMNSLSAGDTAVYYCARGGMITVTTTFDYWGQGTLVTVSS

SEQ ID NO: 3358 - protein, 108 aa, Homo sapiens
DIQMTQSPSSLSASVGDRVTLTCRASQTISSYLNWYQLKPGTAPKLLIYAASSLQSGVPSRFSGSGSGTDFTLTISSLQPEDFATYYCQQSYSNPSITFGQGTRLEIK

SEQ ID NO: 3359 - protein, 129 aa, Homo sapiens
EVQLVESGGGLVKPGGSLRLSCAASGFTFTNAWMSWVRQAPGKGLEWVGRIKSKTDGGTTDYAAPVKGRFTISRDDSKKTLYLQMNSLKTEDTALYYCTTDRRGVRGFMEIVVYNMDVWGQGTTVTVSS

SEQ ID NO: 3360 - protein, 111 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAPWVFGGGTKLTVL

SEQ ID NO: 3361 - protein, 129 aa, Homo sapiens
QVQLVQSGAEVKKPGASVKVSCKVSGYTLPELSIHWVRQAPGKGLEWMGGFDPENAETIYTQKFQGRLTMTEDTSTDTAYMELSSLRSEDTAMYYCATSFVLMPAALGDYSYYYGMDVWGQGTTVTVSS

SEQ ID NO: 3362 - protein, 112 aa, Homo sapiens
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPLTFGGGTKVEIK

SEQ ID NO: 3363 - protein, 117 aa, Homo sapiens
EVQLVESGGGLVQPGGSLRLSCAASRITVSSNYMNWVRQAPGKGLEWVSVIYSGGSTFYADSVKGRFTISRDSSKNTLYLQMNSLRAEDTAVYYCARDFREDAFDMWGQGTMVTVSS

SEQ ID NO: 3364 - protein, 108 aa, Homo sapiens
DIQLTQSPSFLSASVGDRVTIICRASQGISSYLAWYQQKPGKAPKLLIYAASTLQSGVPSRFSGSGSGTEFTLTISSLQPEDFATYYCQQLNSHPQVTFGPGTKVDIK

SEQ ID NO: 3365 - protein, 127 aa, Homo sapiens
EVQLVESGGGVVQPGGSLRLSCAASGFTFDDYAMHWVRQVPGKGLEWVSLISGDGGSTYYADSVKGRFTISRDNSKNSLYVQMNSLRTEDTALYYCVKDRGGSGWDLNHYYYGMDVWGQGTTVTVSS

SEQ ID NO: 3366 - protein, 107 aa, Homo sapiens
DIQLTQSPSFLSASVGDRVTVTCRASQGISSYLAWYQQKPGKAPKLLIYAAYTLQSGVPSRFSGSGSETEFTLTISSLQPEDFATYYCQQVKSYPLTFGGGTKVEIK

SEQ ID NO: 3367 - protein, 123 aa, Homo sapiens
QVQLVESGGGLVKPGGSLRLSCAASGFTFSDYYMSWIRQAPGKGLEWVSYISSSASTKNYADSVKGRFTISRDNAKNSLYLQMNSLRAEDTAVYYCARDWNLYNNSFPAVDYWGQGTLVTVSS

SEQ ID NO: 3368 - protein, 107 aa, Homo sapiens
DIQMTQSPSSLSASVGDRVTVTCRASQGISNYLAWFQQKPGKAPKSLIYAASSLQSGVPSKFSGSGSGTDFTLTISNLQPEDFATYYCQQYKSYPLTFGGGTKVEIK

SEQ ID NO: 3369 - protein, 121 aa, Homo sapiens
EVQLLESGGGLVQPGGSLRLSCAASGFTFSNYALNWVRQAPGKGLEWVSSITGGGGTTYYADPVKGRFTISRDNSKNTLYLLMDSLRAEDTAVYYCASPRSLYSYYAMDVWGQGATVTVSS

SEQ ID NO: 3370 - protein, 108 aa, Homo sapiens
DIQMTQSPSSLSASVGDRVTITCRASQGIRNDLAWYQQKPGKAPERLIYAASSLQSGVPSRFSGSGSGTEFTLTISSLQPEDFATYYCLQHNNYPRYTFGGGTKVEIK

SEQ ID NO: 3371 - protein, 121 aa, Homo sapiens
EVQLVESGGGLVQPGGSLRLACAVSGFTLSDHYIDWVRQAPGKGLEWVARTRDKARRHTTEYAASVKGRFTISRDDAKNSVFLQMNSLKTEDTAVYFCARSYYGYGNFDSWGQGTLVTVSS

SEQ ID NO: 3372 - protein, 107 aa, Homo sapiens
DIQMTQSPSSLSASVGDRVTITCRASQGVRNDLAWYQQRPGKSPKRLIYAASTLQSGVPSRFSGSGSGTEFTLTISRLQPEDFATYYCLQHDSYPYTFGQGTKLEIK

SEQ ID NO: 3373 - protein, 126 aa, Homo sapiens
QVQLQESGPGLVKPSQTLSLTCTVSGGSISSGSYYWSWIRQPAGKGLEWIGRIYTRGSTNYNPSLKSRVTISVDTSKNQFSLRLRSVTAADTAVYYCARERSVTMIISPINCFDPWGQGTLVTVSS

SEQ ID NO: 3374 - protein, 112 aa, Homo sapiens; identical to SEQ ID NO: 2752

SEQ ID NO: 3375 - protein, 127 aa, Homo sapiens
EVQLVESGGGLVQPGRSLRLSCAASGFTFEDYAVHWVRQAPGKGLEWVSGSSWNSGSIGYADSVKGRFIISRDNAKNSLYLQMKSLRPEDTALYYCAKLDVGGYDFVSGHYDAFDIWGQGTMVSVSS

SEQ ID NO: 3376 - protein, 112 aa, Homo sapiens
DAVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPYTFGQGTKLEIK

SEQ ID NO: 3377 - protein, 127 aa, Homo sapiens
EVQLVESGGGVVQPGGSLRLSCAASGFTFDVYAMHWVRQAPGKGLEWVSLISGDGGSTYYADSLKGRFSISRDNSKNSLFLQMNSLRTEDTALYYCAKDRGGSGWDLNYYYYGMDVWGQGTTVTVSS

SEQ ID NO: 3378 - protein, 107 aa, Homo sapiens
DIQLTQSPSFLSASVGDRVTITCRASQGISSYLAWFQQKPGKAPKLLIYAASTLQSGVPSRFSGSGSGTEFTLTISSLQPEDFATYYCQQVNSYPLTFGGGTKVEIK

SEQ ID NO: 3379 - protein, 128 aa, Homo sapiens
QVQLQESGPGLVKASETLSLSCTISGDSIKYYYWTWIRQTPGRGLEWIGYIYYNGETTYNPSLESRVTISVDTSKNQLSLRLTSMTVADTAVYYCARVGRTTVRGVSTTYYYHPMDVWGQGTTVTVSS

SEQ ID NO: 3380 - protein, 112 aa, Homo sapiens
QSVLRQPPSVSGAPGQKVTIYCAGSSSNIGAGYDVHWYQQFPGTAPKLLIYSKTNRPSGVPDRFSGSTSGASASLAITGLRSEDEADYYCQSYDNSQTAYAIFGGGTKVTVL

SEQ ID NO: 3381 - protein, 123 aa, Homo sapiens
EVQLVESGGGVVQPGGSLRLSCAASGFTFDDYAMHWVRQAPGKSLEWVSLIIGDGGGTYYADSVKGRFTISRDNSKNSLYLQMNSLRTEDTAFYYCAKDSSMVQGWVSWFDPWGQGTLVTVSS

SEQ ID NO: 3382 - protein, 108 aa, Homo sapiens
DIQMTQSPSSLSTSVGDRVTITCRASQSISSYLNWYQQKPGKAPKLLIYAASSLQSGVPSRFSGSGSGTDFTLTISSLQPEDFATYYCQQSYNTPPWTFGQGTKLQIK

SEQ ID NO: 3383 - protein, 124 aa, Homo sapiens
QVQVVQSGAEVKKPGSSVKVSCKASGGTSSSYAISWVRQAPGQGLEWMGRIIPILGTTNYAQKFQGRVTITADKSTSTAYMELSSLRSEDTAVYYCATTQGGDYGDNLYYFEYWGQGTLVTVSS

SEQ ID NO: 3384 - protein, 109 aa, Homo sapiens
SYVLTQPPSVSVAPGKTARITCGGNSIGSKSVHWYQQKPGQAPVVVIYYDSDRPSGIPERFSGSNSGSTATLTISRVEAGDEADYYCQVWDSTSDRLYVFGTGTKVTVL

SEQ ID NO: 3385 - protein, 130 aa, Homo sapiens
EVQLVESGGGLVQPGGSLRLSCAASEFTFSSYNMNWVRQAPGKGLEWVSSISSSSSYMYYADSVKGRFTISRDNAKNSLYLQMNSLRAEDTAVYYCAKEPGGRNDILTGYRIGPNWFDSWGQGILVTVSS

SEQ ID NO: 3386 - protein, 113 aa, Homo sapiens
DIVMTQSPDSLAVSLGERATINCKSSQSVLYSSNNKNYLAWYQQKPGQPPKLVIYWASTRESGVPDRFSGSGSGTDFTLTISSLQAEDVAVYYCQQYYITPITFGQGTRLEIK

SEQ ID NO: 3387 - protein, 124 aa, Homo sapiens
EVQLVESGGGLVQPGGSLRLSCAASGFTFSSYWMSWVRQAPGKGLEWVANINQDGSEKYYVDSLKGRFTISRDNAKNSLSLQMNSLRAEDTAVYYCARDYLYYDNSGGTDLDYWGQGTLVTVSS

SEQ ID NO: 3388 - protein, 107 aa, Homo sapiens
DIQMTQSPSSLSASVGDRVTITCRASQGVRNDLGWYQQKPGKAPKRLIYAVSSLQSGVPSRFSGSGSGTEFTLTISSLQPEDFATYYCLQHNSYPYTFGQGTKLEIK

SEQ ID NO: 3389 - protein, 128 aa, Homo sapiens; identical to SEQ ID NO: 3301

SEQ ID NO: 3390 - protein, 108 aa, Homo sapiens
EIVLTQSPGTLSLSPGERATLSCRASQSVISRYLAWYQQKPGQAPRLLIYGASSRATGIPDRFSGSGSGTDFTLTISRLEPEDFAVYYCQKYGSSFPTFGPGTKVDIK

SEQ ID NO: 3391 - protein, 125 aa, Homo sapiens
QLQLQESGPGLVTPSETLSLTCTVSGGSIGSSSYYWGWIRQPPGKGLEWIGSIYYGGSTYYNPSLKGRVTISVDTSRNQFSLKLSSVTAADTAVYYCARTGELVWFREPISLDPWGQGTLVTVSS

SEQ ID NO: 3392 - protein, 107 aa, Homo sapiens
DIQMTQSPSSLSASVGDRVTITCRASQGISNYLAWFQQKPGKAPKSLIYAASILQNGVPSKFSGSGSGTDFTLTISNLQPEDFATYYCQQYKSYPLTFGGGTKVEIK

SEQ ID NO: 3393 - protein, 118 aa, Homo sapiens
QVTLRESGPALVKPTQTLTLTCTFSGFSLSTSGISVSWIRQPPGKALEWLARIDWDDDKYYSTSLETRLTISKDTSKNQVVLTMTNLDPVDTATYYCARAAAGIEDYWGQGTLVTVSS

SEQ ID NO: 3394 - protein, 107 aa, Homo sapiens
DIQMTQSPSSLSASIGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 3395 - protein, 131 aa, Homo sapiens
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARDYPHENDFWSGYYSYYSYGMDVWGQGTTVTVSS

SEQ ID NO: 3396 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 3397 - protein, 119 aa, Homo sapiens
QITLKESGPTLVKPTQTLTLTCTFSESSLSTSGVGVGWIRQPPGKALEWLALIYWDDDKRYSPSLKSRLTITKDTSKNQVVLTMTNMDPVDTATYYCAHLTTETIFDVWGRGTLVTVSS

SEQ ID NO: 3398 - protein, 109 aa, Homo sapiens
QSALTQPASVSGSPGQSITISCTGTSSDVGDYNYVSWYQQHPGKAPKLMIYDVSKRPSGVSNRFSGSKSGYTASLTISGLQAEDEADYYCSSYTSSSVVFGGGTKLTVL

SEQ ID NO: 3399 - protein, 123 aa, Homo sapiens
EVQLVESGGGLVKPGGSLRLSCAASGFIFSSYSMNWVRQAPGKGLEWVSSISTSSSYIYYAESVRGRFTISRDNAKNSLFLQMNSLSPEDTAVYYCARDPTNGYYDSGSSDYWGQGTLVTVSS

SEQ ID NO: 3400 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDLAVYYCQQYYNWPPWTFGQGTKVEIR

SEQ ID NO: 3401 - protein, 128 aa, Homo sapiens
EVQLVESGGGLVQPGGSLRLSCAASGFTFSSDDMHWVRQATGKGLEWVSTIGSAGDTYYPGSVKGRFTISRENAKNSLYLQMNSLRAGDTAVYYCARGVQLQRLASGTYNYYYYMDVWGKGTTVTVSS

SEQ ID NO: 3402 - protein, 108 aa, Homo sapiens
DIQMTQSPSSLSASVGDRVTITCRASQSISSYLNWYQQKPGKAPKLLIYAASSLHSGVPSRFSGSGSGTDFTLTISSLQPEDFATYYCQQSYSFPGLTFGGGTKVEIK

SEQ ID NO: 3403 - protein, 119 aa, Homo sapiens
QVQLQQWGAGLLKPSETLSLTCAVHGGSFSGYYWSWIRQPPGKGLEWIGEINHSGSTNYNPSLKSRVTISVDTSKNQFSLKLTSVTAADTALYYCARGGGYNYGAIDYWGQGTLVTVSS

SEQ ID NO: 3404 - protein, 111 aa, Homo sapiens
QSVLTQPPSASGTPGQRVTISCSGSSSNIGINFVYWYQQLPGTAPKLLIYRNNQRPSEVPDRFSGSKSGTSASLAISGLRSEDEADYYCAAWDDSLSAHVVFGGGTKLTVL

SEQ ID NO: 3405 - protein, 126 aa, Homo sapiens
QLQLQESGPGLVKPSETLSLTCTVSGGSISSSTYYWGWIRQPPGKGLEWIASIYYSGGTYYNPSLKSRVTISVDTSKNQYSLKLSSVTAADTAVYYCARLPDFWSGRAGYYYMDFWGKGTTVTVSS

SEQ ID NO: 3406 - protein, 110 aa, Homo sapiens
DIQMTQSPSSLSASVGDRVTITCRASQGISNYLAWYQQKPGKVPKLLIYAASTLQSGVPSRFSGSGSGTDFTLIISSLQPEDVATYYCQKYSSAPPLTWTFGQGTKVEIK

SEQ ID NO: 3407 - protein, 125 aa, Homo sapiens
QVQLVQSGSELKKPGASVKVSCKTSGYTFTSYAMNWVRQAPGQGLEWMGWINTNTGNPTYAQGFTGRFVFSLDTSVSTAYLQISSLKAEDTALYYCAKTLPTRNLVARGDALDIWGQGTMVTVSS

SEQ ID NO: 3408 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSAFGQGTKVEIK

SEQ ID NO: 3409 - protein, 124 aa, Homo sapiens
QVQLQESGPGPVKPSETLSLFCSVSGGSINSYHWNWLRQSPGKGLEWIGHVYYTGTTKYNPSLKSRVTISIDTSKSQFSLRLSSVTAADTAVYYCARGGGDVSSWSFYYYMDVWGKGTSVTVSS

SEQ ID NO: 3410 - protein, 108 aa, Homo sapiens
VIVMTQSPDSLAVSLGERATINCKSSQSVLYSSLAWYQQKPGQPPKLLIYWTSTRESGVPDRFSGSGSGTDFTLTISSLQAEDVAFYYCQQYFSTPITFGQGTRLEIK

SEQ ID NO: 3411 - protein, 120 aa, Homo sapiens
EVQLVESGGGLVQPGGSLRLSCAASGFTFSNYDMHWVRQGTGTGLEWVSVIGTAGDTYYPDSVKGRFTISRENAKNSLYLQIKSLRAGDTAVYYCARAEYQLLYGYMDVWGKGTTVTVSS

SEQ ID NO: 3412 - protein, 108 aa, Homo sapiens
DIQMTQSPSSLSASVGDRVTITCRASQSISNYLNWYQQKPGKAPKLLIYAASSLQSGVPSRFSGSGSGTDFTLTISSLQPEDFATYYCQQSYSTPPLTFGGGTKVEIK

SEQ ID NO: 3413 - protein, 124 aa, Homo sapiens
EVQLLESGGGLVQPGGSLRLSCAASGFTFSSYAMSWVRQAPGKGLEWVSAIGGSGGSTYYADSVKGRFTISRDNSKNTLYLQMNSLRAEDTAIYYCVKNERMTMIVVVTLFDYWGQGTLVTVSS

SEQ ID NO: 3414 - protein, 110 aa, Homo sapiens
QSVLTQPPSVSAAPGQKVTISCSGNNSNIGNNYVSWYQQLPGTAPKLLIYDNNKRPSGIPDRFSGSKSGTSATLGITGLQTGDEADYYCGTWDSSLNAVVFGGGTKLTVL

SEQ ID NO: 3415 - protein, 119 aa, Homo sapiens
QVQLVESGGGLVKPGGSLRLSCAASGFTFSDYYMSWIRQAPGKGLDWVSYISSSGYTIYYADSVKGRFTISRDNAKNSLYLQMNSLRAEDTAVYYCARFLPSGLYLDYWGQGTLVTVSS

SEQ ID NO: 3416 - protein, 112 aa, Homo sapiens
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSAWGVFGGGTKLTVL

SEQ ID NO: 3417 - protein, 122 aa, Homo sapiens
QVQLVQSGAEVKKPGASVKVSCKVSGYTLIELSMHWVRQAPGKGVEWMGGFDPEDVETIYAQRFQGRVTMTEDTSTDTAYMELSSLRSEDTAVYYCATVPAAITGTTFVWYWGQGTLVTVSS

SEQ ID NO: 3418 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCVAWDDSLNGWVFGGGTKLTVL

SEQ ID NO: 3419 - protein, 129 aa, Homo sapiens
EVQLVESGGGVVRPGGSLRLSCAASGFIFDDYDMTWVRQAPGKGLEWVSGISWNGGNTGYADSVKGRFTISRDNAKNSLYLQMNSLRAEDTALYHCAVIMSPIPRYSGYDWAGGAFDIWGQGTMVTVSS

SEQ ID NO: 3420 - protein, 108 aa, Homo sapiens
SSELTQDPAVSVALGQTVRITCQGDSLRSYYASWYQQKPGQVPILVIYDKNNRPSGIPDRFSGSSSGNTASLTITGAQAEDEADYYCNSRDSSGNAVVFGGGTKLTVL

SEQ ID NO: 3421 - protein, 117 aa, Homo sapiens
QVQLVESGGGLVKPGGSLRLSCAASGFSFSDYYMSWIRQAPGKGLEWVSYMSSSGRTIYYANSVKGRFTISRDNAKNSLYLQMNSLRAEDTAVYFCARDGLRPPDYWGQGTPVTVSS

SEQ ID NO: 3422 - protein, 110 aa, Homo sapiens
QSALTQPASVSGSPGHSIAISCTGTSSDVGSYNLVSWYQQHPGKAPKLMIYEATKRPAGVSNRFSGSKSGNTASLTISGLQAEDEADYYCCSYAGSSTYVFGTGTKVTVL

SEQ ID NO: 3423 - protein, 121 aa, Homo sapiens
QVTLKESGPVLVKPTETLTLTCTVSGFSLINAKMGVSWIRQPPGKALEWLANIFSGDEKSYSTSLKSRLTISKDTSKSQVVLTMTNMDPVDTATYFCARTWWLSSYYMDVWGKGTTVTVSS

SEQ ID NO: 3424 - protein, 107 aa, Homo sapiens
DIQMTQSPSSVSASVGDRVTITCRASQGISSWLAWYQQKPGKAPKLLIYAASSLQSGVPSRFSGSGSGTDFTLTISGLQPEDFATYYCQQTNSFPITFGQGTRLEIK

SEQ ID NO: 3425 - protein, 124 aa, Homo sapiens
QVQLVESGGGVVQPGRSLRLSCAASGFTFSNYAMHWVRQAPGKGLEWVAVISYDGSNKYYADSVKGRFTISRDNSKNTLYLQMNTLRAEDTAVYYCARDWAPAYYDMASAFDMWGQGTMVTVSS

SEQ ID NO: 3426 - protein, 109 aa, Homo sapiens
SYVLTQPPSVSVAPGKTARITCGGNNIGGKSVYWYQQKPGQAPVLVVYDDTDRPSGIPERFSGSNSGNTATLTISRVEAGDEADYYCQVWDSSSDHPGVFGGGTKLTVL

SEQ ID NO: 3427 - protein, 128 aa, Homo sapiens
QVQLVESGGGVVQPGRSLRLSCAASGLTFSSFGMHWVRQAPGKGLEWVAVIWYDGSNKYYADSVKGRFTISRDNSKNTLYLQMNSLRAEDTAVYYCASTQDYYDSSGYTLSYYGMDVWGQGTTVTVSS

SEQ ID NO: 3428 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTYVFGAGTKVTVL

SEQ ID NO: 3429 - protein, 128 aa, Homo sapiens
EVQLLESGGGLVQPGGSLRLSCAASGFTFSSYAMSWVRQAPGKGLEWVSFISGTGGSTYYADSVKGRFTISRDNSKNTLYLQMNSLRAEDTAVYSCAKDGDLPTKYFDWLPAYYFDYWGQGTLVTVSS

SEQ ID NO: 3430 - protein, 111 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSYTSAVFGGGTQLTVL

SEQ ID NO: 3431 - protein, 127 aa, Homo sapiens
QVQLVQSGAEVKKPGASVKVSCKASGDTFTSYYLHWVRQAPGQGLEWMGIINPSGGSTSYAQKFQGRVTMTRDTSTSTVYMELSSLRSEDTAVYYCARIADGAWDEWEPTTHPGDYWGQGTLVTVSS

SEQ ID NO: 3432 - protein, 113 aa, Homo sapiens
DIVMTQSPDSLAVSLGERATINCKSSQSVLYSSNNKNYLAWYQQRPGQPPELLIYWASTRESGVPDRFSGSGSGTDFTLTISSLQAEDVAVYYCQQYYSTPPTFGQGTKVEIK

SEQ ID NO: 3433 - protein, 125 aa, Homo sapiens
QVQLVQSGSELKKPGASVKVSCKASGYTFTRSAMNWVRQAPGQGLEWMGWINTNTGNPTYAQDFTGRFVFSLDTSVSTAYLQISSLKAEDTAVYYCARDRNSGYPDYYYYYMDVWGKGTTVTVSS

SEQ ID NO: 3434 - protein, 112 aa, Homo sapiens
DIVMTQTPLSLSVTPGQPASISCKSSQSLLHSDGKTYLYWYLQKAGQSPQLLMYEVSSRFSGVPDRFSGSGSGTDFTLKISRVEAEDVGVYYCMQSIDSPLTFGGGTKVEIK

SEQ ID NO: 3435 - protein, 128 aa, Homo sapiens
QVQLVESGGGVVQPGRSLRLSCAASGFTFSSYGMHWVRQAPGKGLEWVALIWYDGSNKYYADSVKGRFTISRDNSKNTLYLQMSSLRAEDTAVYYCARDRNIDYPGSGTYLRFGMDVWGLGTTVTASS

SEQ ID NO: 3436 - protein, 107 aa, Homo sapiens
DIQMTQSPSSVSASVGDRVTITCRASQGIFSWLAWYQQKPGKAPNLLIYAASTLQNGVPSRFSGSGSGTDFTLTISNLQPEDFATYYCQQANGPPLTFGGGTKVEIK

SEQ ID NO: 3437 - protein, 122 aa, Homo sapiens
EVQVVESGGGLVKPGGSLRLSCAASGFTFNSYAMNWVRQAPGKGLEWVSSISSSGTYIYYADSVKGRFTISRDNAKNSLYLQMNSLRAEDTAVYYCSSATVVTGGILGFDYWGQGTLVTVSS

SEQ ID NO: 3438 - protein, 108 aa, Homo sapiens
SYELTQPPSVSVSPGQTARITCSGDALPNQYAFWYQQKPGQAPVMVIYKDSERPSGIPERFSGYSSGTIVTLTISGVQAEDEAEYYCQSADSSGTNVVFGGGTKLTVL

SEQ ID NO: 3439 - protein, 120 aa, Homo sapiens
QVQLVQSGAEVKKPGASVKVSCKASGYTFTTYDINWVRQATGQGLEWMGWMNPNSGYTDSAQKFQGRVTMTRNTSISTAYMELSSLRSEDTAVYYCASGRGVKTYYFDYWGQGTLVTVSS

SEQ ID NO: 3440 - protein, 106 aa, Homo sapiens
SYELTQPPSVSVSPGQTASITCSGDKLGDKSACWYQQKPGQSPVLVICQDTKRPSGIPERFSGSNSGNTATLTISGTQAMDEADYYCQAWDSRTVVFGGGTKLTVL

SEQ ID NO: 3441 - protein, 119 aa, Homo sapiens
EVQLVQSGAEVKKPGESLKISCKASGHSFTTYWIGWVRQMPGKGLEWMGIIYPGDSDTRYSPSFQGQVTISADKSITTAYLQWNSLKASDTAMYYCARTPTLYNWFDPWGQGTLVTVSS

SEQ ID NO: 3442 - protein, 111 aa, Homo sapiens
QSVLTQPPSASGTPGQRVTISCSGSSSNIGSNSVNWYQQLPGTAPKLLIYSNNQRPSGVPDRFSGSKSGTSASLAISGLQSEDEADYYCAAWDDSMNGSWVFGGGTKLTVL

SEQ ID NO: 3443 - protein, 117 aa, Homo sapiens
QVQLVQSGAEVKKPGSSVKVSCKASGGTFSSYAISWVRQAPGQGLEWMGGIIPIFGTANYAQKFQGRVTITADESTRTAYMELSSLRSEDTAVYYCAREEGFHSSVWGQGTLVTVSS

SEQ ID NO: 3444 - protein, 109 aa, Homo sapiens
EIVLTQSPATLSLSPGGRATLSCRASQSVSSFLAWYQQKPGQAPRLLIYDASNRATGIPARFSGSGSGTDFTLTISSLEPEDFAVYYCQQRSNWPPRITFGGGTKVEIK

SEQ ID NO: 3445 - protein, 125 aa, Homo sapiens
EVQLVESGGGLVQPGRSLTLSCAGSGFTFDDYAMHWVRQAPGKGLEWVSGISWNSGSIGYADSVKGRFTISRDNAKNSLYLQMNSLRAEDTALYYCAKDVSYDSSGYYNNAFDIWGQGTMVTVSS

SEQ ID NO: 3446 - protein, 107 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLYSYPVTFGQGTRLEIK

SEQ ID NO: 3447 - protein, 125 aa, Homo sapiens
QVQLVQSGSELKKPGASVKVSCKASGYSFTSYAMNWVRQAPGQGLEWMGWINTNTGNPTYAQGFTGRFVFSLDTSVSTAYLQITSLKAEDTAVYYCARDWEVPAPYYSYYYMDVWGKGTTVTVSS

SEQ ID NO: 3448 - protein, 112 aa, Homo sapiens
DIVMTQTPLSLSVTPGQPASISCKSSQSLLHSDGKTYLYWYLQKSGQSPQLLIYEISDRFSGVPDRFSGSGSGTNFTLKISRVEAEDVGVYYCMQSIQLPYTFGQGTKLEIK

SEQ ID NO: 3449 - protein, 116 aa, Homo sapiens
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGDTIFGAWGQGTLVTVSS

SEQ ID NO: 3450 - protein, 113 aa, Homo sapiens
DIVMTQSPDSLAVSLGERATINCKSSQSVLYSFSNKNYLAWYQQKLGQPPKLLIYWASTRESGVPDRFGGSGSGTDFTLTISSLQAEDVAVYYCQQYYSTPWTFGQGTKVEIK

SEQ ID NO: 3451 - protein, 124 aa, Homo sapiens
QVQLVQSGAEVKKPGASVKVSCKASGYTFTSYAMHWVRQAPGQRLDWMGWINAGNGNTKYSQKFQDRVTITRDTSASTAYMELSSLRSEDTAVYYCAVPRGYSGYDYEGAFDYWGQGTLVTVSS

SEQ ID NO: 3452 - protein, 107 aa, Homo sapiens
DIQMTQSPSSLSASVGDRVTITCQASQDISNYLNWYQQKPGKAPELLIYDAFNLEIGVPARFSGSGSGTDFTFTISSLQPEDIATYYCQQYDNLPLTFGGGTKVEIK

SEQ ID NO: 3453 - protein, 123 aa, Homo sapiens
EVQLVESGGVVVQPGGSLRLSCAASGFSFDDYTMHWVRQAPGKGLEWVSFVSWDGGSTYYADSVKGRFTISRDKSKNSLYLQMNSLRTEDTALYYCAREDSSGYPSVSYFDYWGQGTLVTVSS

SEQ ID NO: 3454 - protein, 108 aa, Homo sapiens
GIQLTQSPSFLSASVGDRVTITCRASQGISSYLAWYQQKPGKAPKLLIYAASTLQSGVPSRFSGSGSGTEFTLTINSLQPEDFAAYYCQQVNSYPELTFGGGTKVEIK

SEQ ID NO: 3455 - protein, 125 aa, Homo sapiens
QVQLQESGPGLVKPSETLSLTCTVSGASISSGKNHWSWIRQPAGQGLEWIGRMTTGVTTGGITAYKSSLKSRVTISLDTSRNQFSLSLSSVTAADTAVYYCARDPVDGNSFFDSWGQGTLVTVSS

SEQ ID NO: 3456 - protein, 111 aa, Homo sapiens
EIVLTQSPGTLSLSLGERGTLSCRASQSVDSRYLDWYQQRPGQAPRLVIYGASTRATGIPDRFSGSGSGTDFTLTISRLEPEDFAVYYCQYYINSTPPQHTFGQGTKVEIK

SEQ ID NO: 3457 - protein, 122 aa, Homo sapiens
QVQLVQSGAEVKKPGASVKVSCKVSGYTLIELSMHWVRQAPGKGLEWMGGFDPEEAETFYAQKFQGRVTMTEDTSTDTAYMELSSLSSEDTAVYYCATVPAAIGGTAFVWYWGQGTLVTVSS

SEQ ID NO: 3458 - protein, 110 aa, Homo sapiens
QSVLTQPPSASGTPGQRVTISCSGSSSNIGSSTVNWYQQLPGTAPKLLIYSNNQRPSGVPDRFSGSKSGTSASLAISGLQSEDEAEYYCAAWDDSLNGWVFGGGTKLTVL

SEQ ID NO: 3459 - protein, 121 aa, Homo sapiens
QVQLQESGPGLVKPSQTLSLTCTVSGGSSSSGGYYWSWIRQPPGKGLEWIGYIYNSGSTYHNPSLKSRVTISVDTSKNQFSLKVSSVTAADTAVYYCARMNTVTTWYFDYWGQGTLVTVSS

SEQ ID NO: 3460 - protein, 108 aa, Homo sapiens
QSALTQPRSVSGSPGQSVTISCTGTSSDVGGYNYVSWYQQHPGKAPKLMIYDVSKRPSGVPDRFSGSKSGNTASLTISGLQAEDEADYYCCSYAGSWVFGGGTKLTVL

SEQ ID NO: 3461 - protein, 128 aa, Homo sapiens
EVQLLESGGGLVQPGGSLRLSCAASGFTFSIYAMSWVRQAPGKGLEWVSLLSSSGGSTYYADSVKGRFTISRDNSKNTLYLQMNSLRAEDTAVYYCAKDGGGSWSPVHYYYYYAMDVWGQGTTVTVSS

SEQ ID NO: 3462 - protein, 112 aa, Homo sapiens
QSALTQPASVSGSPGQSITISCTGTSNDVGSYNLVSWYQQHPGKAPKLMIYEVTKRPSGVSNRFSGSKSGNTASLTISGLQAEDEADYYCCSYAGSSTSYVLFGGGTKLTVL

SEQ ID NO: 3463 - protein, 128 aa, Homo sapiens
EVQLVESGGGLVKPGGSLRLSCAASGFTFSNYNMNWVRQAPGKGLEWVSSISSRSNYIYYAGSVKGRFTISRDNAKNSLYLQMNSLRAEDTAVYYCARAGNTYYGILTDYYPDAFDMWGQGTMVTVSS

SEQ ID NO: 3464 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAIYYCQQYHNWPPWTFGQGTKVEIK

SEQ ID NO: 3465 - protein, 128 aa, Homo sapiens
QMQLVQSGPEMKKPGTSVKVSCKASGFTFTSSAIQWVRQARGQRLEWVGWIVVGSDVTNYAQKFQERVTITRDMSTSTAYMELRSLRSEDTAVYYCAADREYCTNGVCRQNYYYMDVWGKGTTVTVSS

SEQ ID NO: 3466 - protein, 108 aa, Homo sapiens
SYELTQPPSVSVSPGQTARITCSGDALPKQYAYWYQQKPGQAPVLVIYKDSERPSGIPERFSGSSSGTTVTLTISGVQAGDEADYFCQSADSSATYVMFGGGTKLTVL

SEQ ID NO: 3467 - protein, 123 aa, Homo sapiens
QVQLVQSGAEVKKPGASVKVSCKASGNTFSSYYMHWVRQAPGQGLEWMGIINLSGGSTRYAQKFQGSVTMTRDTSTSTVYMELSSLRSEDTAVYYCATEAHIVVVPAAPFDYWGQGTLVIVSS

SEQ ID NO: 3468 - protein, 109 aa, Homo sapiens
EIVLTQSPATLSLSPGERATLSCRASQSVSSYLAWYQQKPGQAPRLLIYDVSNRATGIPARFSGSGSGTDFTLTISSLEPEDFAVYYCQQRSNWPPTYTFGQGTKLEIK

SEQ ID NO: 3469 - protein, 126 aa, Homo sapiens
QVQLVESGGGVVQPGRSLRLSCAASGFTFSRYGMHWVRQAPGKGLEWVAVMSYDGSNKYYADSVKGRFTISRDNSKNTLYLQMNSLKAEDTAVYYCAKKGAPYCGIDCYRGYFDYWGQGTLVTVSS

SEQ ID NO: 3470 - protein, 107 aa, Homo sapiens
DIQMTQSPSSLSASVGDRVTITCQASQDITNYLNWYQQKPGKAPKLLIYDASNLETGVPSRFSGSGSGTDFTFTISSLQPEDIATYYCQQYDNLPLTFGGGTKVEIK

SEQ ID NO: 3471 - protein, 127 aa, Homo sapiens
QVQLVESGGGVVQPGRSLRLSCAASGFSFSNYGMHWVRQAPGKGLEWVAVISYGGSDKYYADSVKGRFTISRDTSKNTLYLQMNSLRAEDTAVYYCAKAYRGDLITFGGVIAPLDYWGQGTLVTVSS

SEQ ID NO: 3472 - protein, 111 aa, Homo sapiens
QSVLTQPPSVSGAPGQRVTFSCTGSSSNIGAGYDVYWYQQLPGTAPKLLIYGNTNRPSGVPDRFSGSKSGTSASLAITGLQAEDEADYYCQSYDSSLSVLVFGTGTKVTVL

SEQ ID NO: 3473 - protein, 118 aa, Homo sapiens
QVQLVQSGSELKKPGASVKVSCKASGYTFTNYAMNWVRQAPGQGLEWMGWIYTNTGNPTYAQGFTGRFVFSLDTSVSTAYLQISSLKAEDTAVYYCAREFVGWNFDYWGQGTLVTVSS

SEQ ID NO: 3474 - protein, 108 aa, Homo sapiens
SSELTQDPAVSVALGQTVRITCQGDSLRSYYASWYQQKPGQAPVLVIYGKNNRPSGIPDRFSGSRSGNTASLTITGAQAEDEADYYCNSRDNNGNAWVFGGGTKLTVR

SEQ ID NO: 3475 - protein, 124 aa, Homo sapiens
QLQLQESGPGLVKPSETLSLTCTVSGGSISSSSYYWGWVRQPPGKGLEWIGNIYYSGSTYYNPSLKSRVTISVDTSKNQFSLKLSSVTAADTAVYYCARDGAEFTVTGYAMDVWGQGTTVTVSS

SEQ ID NO: 3476 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPYTFGQGTKLEIK

SEQ ID NO: 3477 - protein, 123 aa, Homo sapiens
QMHLVQSGPEVKKPGTSVKVSCKASGFTFTSSAMQWVRQARGQRLEWIGWIVVGSGNTNYAQKFQERVTITRDMSTSTAYMELSSLRSEDTAVYYCAAPHCNRTSCYDGFDIWGQGTMVTVSS

SEQ ID NO: 3478 - protein, 108 aa, Homo sapiens
EIVLTQSPGTLSLSPGERATLSCRASQSVRSSYLAWYQQKPGQAPRLLIYGASSRATGIPDRISGSGSGTDFTLTISRLEPEDFAVYYCQQYGSSPWTFGQGTKVEIK

SEQ ID NO: 3479 - protein, 132 aa, Homo sapiens
QLQLQGSGPGLVKPSETLSLTCTVSGGSISSSTYYWGWIRQPPGKGLEWIGTIYYSGSTYSNPSLKSRVTISVDTSKNQFSLKLSSVTAADTAVYYCARQVGYDFVWGSYRSVGEPHYFDCWGQGTLVTVSS

SEQ ID NO: 3480 - protein, 107 aa, Homo sapiens
DIQMTQSPSTLSASVGDRVTITCRASQSINSWLAWYQHKPGKAPKLLIYKASSLESGVPSRFSGSGSGTEFTLTITSLQPDDFATYYCQQFHTYSYTFGLGTKLEIK

SEQ ID NO: 3481 - protein, 130 aa, Homo sapiens
QVTLRESGPALVKPTQTLTLTCTFSGFSLSTSGMCVSWIRQPPGKALEWLALIGWDDDKYYSPSLKTRLTISKDTSKNQVVLTMTNMDPVDTATYYCARTRPTGYSGYDFGFPEVFFDPWGQGTLVTVSS

SEQ ID NO: 3482 - protein, 107 aa, Homo sapiens
EIVMTQSPATLSVSPGERAALSCRASQSVSSNLAWYQQKPGQAPRLLIYSASTRATGIPARFSGSGSGTYFTLTISSLQSEDFAVYYCQQYNNWPLTFGQGTKVEIK

SEQ ID NO: 3483 - protein, 130 aa, Homo sapiens
QVQLVESGGGVVQPGRSLRLSCAASGFTFSSHAMHWVRQAPGKGLEWVAVISYDGSNKHYADSVKGRFTISRDSSKSTLYLQMNRLRAEDTAVYYCARDHGVMGAFLSRVSPWGGAFDSWGQGTLVTVSS

SEQ ID NO: 3484 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPYTFGQGTKVEIK

SEQ ID NO: 3485 - protein, 115 aa, Homo sapiens
EVQLVESGGGLVQPGGSRRLSCAASGFTFSSYWMNWVRQAPGKGLEWVANIKEDGSDKYYVDSVKGRFTISRDNSKNSLYLQMNSLRVEDTAVYYCARGHGFDPWGQGTLVTVSS

SEQ ID NO: 3486 - protein, 108 aa, Homo sapiens
SSELTQDPAVSVALGQTVRITCQGDSLRSYSASWFQQKPGQAPVLVIYVKKNRPSGIPDRFSGSSSGNTASLTITGAQAEDEADYYCNSRDTSGNHYVFGTGTKVTVL

SEQ ID NO: 3487 - protein, 117 aa, Homo sapiens
EVQLVESGGGLIQPGGSLRLSCAASGVTVSSNYMTWVRQAPGKGLEWVSVIYSGGSTYYADSVKGRFTISRDSSKNTLYLQMNSLRAEDTAVYYCARDLVYYGMDVWGQGTTVTVSS

SEQ ID NO: 3488 - protein, 107 aa, Homo sapiens
DIQLTQSPSFLSASVGDRVTITCRASQGISSYLAWYQQKPGKAPRLLIYAASTLQSGVPSRFSGSGSGTEFTLTISSLQPEDFATYYCQLLNSDRFTFGPGTKVDIK

SEQ ID NO: 3489 - protein, 124 aa, Homo sapiens
EVHLLESGGGLVQPGGSLRLSCAVSGFTFSSYVMSWVRQAPGKGLEWVSAISGSGGSIYYADSVKGRFTISRDNSKNTLYLQMNSLRAEDTAVYYCAKDPSTSSNYYSFYLDVWGKGTTVTVSS

SEQ ID NO: 3490 - protein, 112 aa, Homo sapiens
QSALTQPASVSGSPGQSITISCTGTSRDVGSYNLVSWYQQHPGKAPKLMIYEGSKRPSGVSNRFSGSKSGNTASLTISGLQAEDEADYYCCSYAGSSTSYVVFGGGTKLTVL

SEQ ID NO: 3491 - protein, 120 aa, Homo sapiens
QVQLVQSGAEVKKPGSSVKVSCKASGGTFSSYGVSWVRQAPGQGLEWMGGIIPIFGTANYAQKFQGRVTLTADESTSTAYMELSSLRSEDTAVYYCAIWGDDLELEVHYWGQGTLVTVSS

SEQ ID NO: 3492 - protein, 108 aa, Homo sapiens
EIVLTQSPATLSLSPGERATLSCRASQSIISYLAWYQQKPGQAPRLLIYDASNRATGIPARFSGSGSGTDFTLTISSLEPEDFAVYYCQQHSNWPPFTFGPGTKVDIK

SEQ ID NO: 3493 - protein, 123 aa, Homo sapiens
QVQLQESGPGLVKPSETLSLTCTVSGGSISSYYWSWIRQPPGKGLEWIGYIYYSGSTNYNPSLKSRVTISVDTSKHQFSLNLSSVTAADTAVYYCARGLLERPLYYYYYMDVWGKGTTVTVSS

SEQ ID NO: 3494 - protein, 110 aa, Homo sapiens
QSVLTQPPSASGTPGQRVTISCSGSSSNIGSNPVNWYQQLPRTAPTLLIYSNSQRPSGVPDRFSGSKSGTSASLAISGLQSEDEADYYCAAWDDSLNGVVFGGGTKLTVL

SEQ ID NO: 3495 - protein, 118 aa, Homo sapiens
QVQLVQSGAEVKKPGASVKVSCKISGHSFTTFGISWVRQAPGQGLEWMGWISPYNGNTDYAQNLQGRITMTTDTSTTTAYMELRSLRSDDTAIYYCARLLRGGALAYWGQGTLVTVSS

SEQ ID NO: 3496 - protein, 108 aa, Homo sapiens
EVVLTQSPGTLSLSPGERATLSCRASQSVTNGDLAWYQQKPGQAPRLLIYGASSRATDIPDRFSGSGSGTDFTLTISRLEPDDFAVYYCQHYSSSPVSFGQGTKLEIK

SEQ ID NO: 3497 - protein, 118 aa, Homo sapiens
QVQLVESGGGVVQPGRSLRLSCAASGFTFRSYGMHWVRQAPGKGLEWVAVLSYDGSNKYYADSVKGRFTISRDNSKNTLYLQMNSLRAEDTAVYYCVKDDSVAGTGYWGQGTLVTVSS

SEQ ID NO: 3498 - protein, 113 aa, Homo sapiens
DIVMTQSPDSLAVSLGERATINCKSSQSVLYSSSNKNCLAWFQQKPGQPPKLLIYWASSRESGVPDRFSGSGSGTDFTLTISSLQAEDVAVYYCQQYYSTPQTFGQGTKVEIK

SEQ ID NO: 3499 - protein, 123 aa, Homo sapiens
EVQLVESGGGLVQPGRSLRLSCAASGFPFNYYAMHWVRQAPGKGLEWVSGISWNSGTIGYADSVKGRFTISRDNAKNSLYLQMNSLRAEDTALYYCAKDRRPSGRYYYGMDVWGQGTTVTVSS

SEQ ID NO: 3500 - protein, 110 aa, Homo sapiens
NFMLTQPHSVSESPGKTVTISCTRSSGSSASNYVQWYQQRPGSAPTAVIYEDNQRPSGVPDRFSGSIDSSSNSASLTISGLKTEDEADYYCQSSDSTNLVFGGGTKLTVL

SEQ ID NO: 3501 - protein, 123 aa, Homo sapiens
EVQLVESGGGLVQPGGSLRLSCAASGFTFSSYDMHWVRQVTGKGLEWVSAIGTSGDTYYPGSVKGRFTISRENAKNSLYLQMNSLRVGDTAVYYCARANYFDVSGFYLHFDLWGRGTLVTVSS

SEQ ID NO: 3502 - protein, 108 aa, Homo sapiens
DIQMTQSPSSLSASVGDRVTITCRASQIISSYLNWYQQKPGKAPKLLIYAASSLQSGVPSRFSGSGSGTDFTLTISSLQPEDFATYYCQQSYTTLALTFGGGTKVEIK

SEQ ID NO: 3503 - protein, 122 aa, Homo sapiens
QVQLVQSGAEVKKPGASVKVSCKVSGYTLIELSMHWVRQAPGKGLEWMGGFDPEDVETIYAQKFQGRVTMTEDTSTDTAYMELSSLRSEDTAVYYCATVPAAITGKTFVWYWGQGTLVTVSS

SEQ ID NO: 3504 - protein, 110 aa, Homo sapiens
QSVLTQPPSASGTPGQRVTISCSGSSSNIGNNTVNWYQQLPGTAPKLLIYSNNQRPSGVPDRFSGSKSGTSASLAISGLQSEDEADYYCVAWDDSLNGWVFGGGTKLTVL

SEQ ID NO: 3505 - protein, 132 aa, Homo sapiens
QVQLVESGGGVVQPGRSLRLSCAASEFTFSSYGMHWVRQAPGKGLEWVAVISHDGSNEYYADSVKGRFTISRDNSKNTLYLQMNSLRAEDTAVYYCAKWRGPHRGYYDRSGYYLGSSRDDYWGQGTLVTVSS

SEQ ID NO: 3506 - protein, 109 aa, Homo sapiens
DIQMTQSPSSLSASVRDRVTITCQASQDISNYLNWYQQKPGKAPKLLIYDASNLETGVPSRFSGSGSGTDFTFTISSLQPEDIATYYCQQYDNLLPIFTFGPGTTVDIK

SEQ ID NO: 3507 - protein, 120 aa, Homo sapiens
QVQLVQSGAEVKKPGSSVKVSCKASGGTFSNYAINWVRLAPGQGLEWMGGIIPIFGTANYAQKFQGRVTITADESTSTAYMELSSLRSEDTAVYYCAGDLGDYGPPEDYWGQGTLVTVSS

SEQ ID NO: 3508 - protein, 108 aa, Homo sapiens
EIVLTQSPATLSLSPGERAALSCRASQSVSTFLAWYQHKPGQAPRLLIYDASNRATGIPARFSGSGSGTDFTLTISSLEPEDFAVYYCQRRSNWPPFTFGGGTKVEIK

SEQ ID NO: 3509 - protein, 121 aa, Homo sapiens
QVQLVQSGAEVKKPGASVKVSCNVSGYTLPELSMHWVRQAPGKGLEWMGGFDPEDGETISAQKFLGRVTMTEDTSTDTAYMELSSLRSEDTAVYYCATGTAVVTSYWFDPWGQGTLVTVSS

SEQ ID NO: 3510 - protein, 111 aa, Homo sapiens
QSALTQPASVSGSPGQSITISCTGTSSDVGGYNSVSWYQQHPGKAPKLMIYDVSNRPSGVSNRFSGSKSGNTASLTISGLQAEDEADYYCSSYTSSSTLRVFGGGTKLTVL

SEQ ID NO: 3511 - protein, 121 aa, Homo sapiens
QVQLVESGGGVVQPGRSLRLSCAASGFTFNSYAMYWIRQAPGKGLEWVAVISYDGSNKYYADSVKGRFTISSDNSKNTLYLQMNSLRAEDTAVYYCARAGTGNYLSYFDYWGQGTLVTVSS

SEQ ID NO: 3512 - protein, 108 aa, Homo sapiens
EIVMTQSPATLSVSPGERATLSCRASQSVSSNLAWYQQKPGQAPRLLIYRASTRATGIPARFSGSGSGTEFTLTISSLQAEDFAVYFCQQYNNWPPYTFGQGTKLEIK

SEQ ID NO: 3513 - protein, 130 aa, Homo sapiens
EVQLVESGGGLVQPGGSLRLSCAASGFTFSSYWMSWVRQAPGKGLEWVANINKDGSEKYYVDSVKGRFTISRDNAKNSLYLQMNSLRAEDTAVYFCARDYRYFDWLLSQIDLEIDYFDYWGQGTLVTVSS

SEQ ID NO: 3514 - protein, 107 aa, Homo sapiens
DIQMTQSPSSLSASVGDRVTITCRASQSISSYLNWYQQKPGKAPKVLIYAASSLQSGVPSRFSGSGSGTDFTLTISSLQPEDFATYYCQQSYSTPLTFGGGTKVEIK

SEQ ID NO: 3515 - protein, 121 aa, Homo sapiens
QVQLVESGGGVVQPGRSLRLSCAASGFTFSTYAMHWVRQAPGKGLEWVAVISYDGSNKYYADSVKGRFTISRDNSKNTLYLQMNSLRAEDTAVYYCAKSGSGSYLSHFDYWGQGTLVTVSS

SEQ ID NO: 3516 - protein, 105 aa, Homo sapiens
DIQMTQSPSTLSASVGDRVTITCRASQTISRWLAWYQQKPGKAPKLLIYKASNLESGVPSRFSGSGSGTEFTLTISSLQPDDFATYYCQQYNSYSFGQGTKVEIK

SEQ ID NO: 3517 - protein, 124 aa, Homo sapiens
EVQLLESGGGLVQPGGSLRLSCAASGFTFSSYVMSWVRQAPGKGLEWVSAISGSGGSSYYADSVKGRFTISRDNSKNTLYLQMNSLRVEDTAVYYCAKDPSGSGTYYYYYMDVWGKGTTVTVSS

SEQ ID NO: 3518 - protein, 112 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSSFYVVFGGGTKLTVL

SEQ ID NO: 3519 - protein, 122 aa, Homo sapiens
EVQLVESGGGLVQPGGSLRLSCAASGFTFGTYDMHWVRQTTGKGLEWVSVIGTAGDTYYPGSVKGRFTISRENAKNSLYLQMNSLRAGDTAVYYCARAGYDSSGYYSFFDYWGQGTLVTVSS

SEQ ID NO: 3520 - protein, 108 aa, Homo sapiens
DIQMTQSPSSLSASVGDRVTITCRASQSISSYLNWYQQKPGKGPKLLIYAASSLQSGVPSRFSGSGSGTDFTLTISSLQPEDFATYYCQQSYSTLALTFGGGTKVEIK

SEQ ID NO: 3521 - protein, 117 aa, Homo sapiens
EVQLVESGGGLIQPGGSLRLSCAASEFIVSSNYMSWVRQAPGKGLEWVSVIYSGGSTYYADSVKGRFTISRDNSKNTLYLQMNSLRAEDTAVYYCARDYGDYYFDYWGQGTLVTVSS

SEQ ID NO: 3522 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNTWPRTFGLGTKVEIK

SEQ ID NO: 3523 - protein, 121 aa, Homo sapiens
QVHLVESGGGVVQPGRSLRLSCAASGFTFSSYAMHWVRQAPGKGLEWVAVISYDGSNKYYADSVRGRITISRDNSKNTLYLQMNSLRAEDTAVYYCARALSAGYSSSFDYWGQGTLVTVSS

SEQ ID NO: 3524 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPSFGQGTKLEIK

SEQ ID NO: 3525 - protein, 121 aa, Homo sapiens
QVQLVESGGGVVQPGRSLRLSCAASGFIFSTYAMHWVRQAPGKGLEWVAVISYDGFNKYYADSVKGRFTISRDNSKNTLYLQMNSLRAEDTAVFYCARARGGNYGSAFDIWGQGTMVTVSS

SEQ ID NO: 3526 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQVEDEADYYCCSYAGSRPWVFGGGTKLTVL

SEQ ID NO: 3527 - protein, 116 aa, Homo sapiens
QVQLVESGGGLVKPGGSLRLSCAASGFTFSDYYMTWIRQAPGKGLEWVSYISSSGNRIYYADSVKGRFTISRDNAKNSLYLQMNSLRAEDTAMYYCATGWELLFNWGQGTLVTVSS

SEQ ID NO: 3528 - protein, 108 aa, Homo sapiens
EIVLTQSPGTLSLSPGERATLSCRASQSVSSSYLAWYQQKPGQAPRLLIYGASTRATGIPDRFSGSGSGTDFTLTISRLEPEDFAVYFCQQFHESRGTFGPGTKVQIK

SEQ ID NO: 3529 - protein, 124 aa, Homo sapiens
QLQLQESGPGLVKPSATLSLTCTVSGGPINSRGYSWGWIRQPPGKGLEWVGAVYYSGSTNYKPSLKSRVTISVDTSKSQFSLKVNSVTAADTAVYYCVGESGRLRFLGNYMDVWGKGATVTVSS

SEQ ID NO: 3530 - protein, 110 aa, Homo sapiens
QSVLTQPPSASGTPGRRVIISCSGSGSNIGSNTVNWYQQSPGTAPKLLIYSNNQRPSGVPDRLSGSKTGTSASLAISGLQSEDEADYYCAAWDDTLNGWVFGGGTKLNVL

SEQ ID NO: 3531 - protein, 125 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKAEDTAVYYCARDGEAPSGPYYYYYMDVWGKGTTVTVSS

SEQ ID NO: 3532 - protein, 112 aa, Homo sapiens
DIVMTQTPLSLSVTPGQPASISCKSSQSLLHSDGKTYLYWYLQKPGQSPQLLIYEVSDRFSGVPDRFSGSGSGTDFTLKISRVEAEDVGVYYCMQSLQLPYTFGQGTKLEIK

SEQ ID NO: 3533 - protein, 123 aa, Homo sapiens
QVQLVQSGSDLKKPGASVKISCRASGYTLSNYAMNWVRQAPGHGLEWMGWINTNTGTPTYAQGFTGRFAFSLDTSVNTAYLQISSLQADDTAVYYCARDPGWQQLVENYFDFWGQGTLVTVSS

SEQ ID NO: 3534 - protein, 107 aa, Homo sapiens
EIVMTQSPATLSVSPGESATLSCRASQSVGSNLAWYQQVPGQAPRLLIYGTSTRATGIPARFSGRGSGTEFTLTISSLQSEDIAVYYCQQYNNWPWTFGQGTKVEIR

SEQ ID NO: 3535 - protein, 132 aa, Homo sapiens
QVQLQGSGPGLVKPSQTLSLTCTVSGGSISSGNYYWSWIRQPAGKGLEWIGRIYSSGSGNTKYNPSLKSRVTISVDTSKNQFSLKLSSVTAADTAVYYCASGEILLTAAGTEDYSYYGMDVWGQGTTVTVSS

SEQ ID NO: 3536 - protein, 106 aa, Homo sapiens
SYELTQPPSVSVSPGQTASITCSGDKLGDKYACWYQQKPGQSPVLVIYQDSKRPSGIPERFSGSNSGNTATLTISGTQAMDEADYYCQAWDSSTAVFGTGTKVTVL

SEQ ID NO: 3537 - protein, 117 aa, Homo sapiens
EVQLVESGGGLVQRGGSLRLSCAASGIIVTSNYMSWVRQAPGKGLEWVSLIYPGGSTYYVDSVKGRFTISRDNSKNTLYLQMNSLRVEDTAVYYCARDFQEGAFDIWGQGTMVTVSS

SEQ ID NO: 3538 - protein, 108 aa, Homo sapiens
DIQLTQSPSFLSPSVGDRVTITCRASQGIASYLAWYQQKPGKAPKLLIYAASTLQSGVPSRFSGSGSGTEFTLTISSLQPEDFATYYCQQLNSYPPITFGPGTKVDIK

SEQ ID NO: 3539 - protein, 122 aa, Homo sapiens
QVQLVQSGAEVKKPGSSLRVSCKASGGTFSSYVISWVRQAPGQGLEWMGRIIPILGIPNYAQTFQDRVTITADKSTGTAYMDLSSLRCEDTAVYYCAREGGYCRSTSCFDYWGQGILVTVSS

SEQ ID NO: 3540 - protein, 111 aa, Homo sapiens
QSVLTQPPSVSGAPGQRVTISCTGRNSNIGAGYDVHWYQQLPGTAPKVLIYNNRNRPSGVPDRFSGSKSGTSASLAITGLQAEDEADYYCQSYDSSLSDVVFGGGTKLTVL

SEQ ID NO: 3541 - protein, 119 aa, Homo sapiens
QVTLRESGPALVKPTQTLTLTCTFSGFSLSTSGMCVSWIRQPPGKALDWLARIDWDDDKYYSTSLQTRLTISKDTSKNQVVLTMTNMDPVDTATYYCARETPVTTIDYWGQGTLVTVSS

SEQ ID NO: 3542 - protein, 107 aa, Homo sapiens
DIQMTQSPSSLSASVGDRVTITCRASQSIRTYLNWYQQKPGKAPNLLIYAASSLQRGVPSRFSGSGSGTDFTLTISSLQPEDFATYYCQQSYSTPRTFGQGTKVEIK

SEQ ID NO: 3543 - protein, 122 aa, Homo sapiens
QVQLVQSGAEVKKPGASVKVSCKVSGYTLIELSMHWVRQAPGKGLEWMGGFDPENTETIYAQKFQGRVTMTEDTSTDTAYMELSSLRSEDTAVYYCATGPASFGELFSSYYWGQGTLVTVSS

SEQ ID NO: 3544 - protein, 110 aa, Homo sapiens
QSVLTQPPSASGTPGQRVTISCSGSSSNIGRNYLYWYQQLPGTAPKLLIYRNNQRPSGVPDRFSGSKSGTSASLAISGLRSEDEADYYCAAWDDSLSGGVFGGGTKLTVL

SEQ ID NO: 3545 - protein, 127 aa, Homo sapiens
EVQLVESGGGVVQPGGSLRLSCAATGFTFDAYAMHWVRQAPGKGLEWVSLISGDGSSTYFADSVKGRFTISRDNSKNSLYLQMNSLTTEDTALYHCGKDRGGSGWDLNYYYYGLDVWGQGTTVTVSS

SEQ ID NO: 3546 - protein, 107 aa, Homo sapiens
DIQLTQSPSFLSASVGDRVTITCRASQGIRSYLAWYQQKPGKAPKLLIYAAYSLQSGVPSRFSGSGSGTEFTLTISSLQPEDFATYYCQQVNSYPLTFGGGTKVEVK

SEQ ID NO: 3547 - protein, 123 aa, Homo sapiens
QVQLVQSGAEVKKPGASVKVSCKVSGYTLIELSMHWVRQAPGKGLEWMGGFDPEDGETIYAQKFQGRVTMTEDTSTDTAYMELSSLRSEDTAVYYCATAPPMGHSLTHWFDPWGQGTLVTVSS

SEQ ID NO: 3548 - protein, 110 aa, Homo sapiens
QSVLTQPPSASGTPGQRVTISCSGSSSNIGSNTVNWYQQLPGTAPKLLIFNNNQRPSGVPDRFSGSKSGTSASLAISGLQSEDEADYYCAAWDDSLNGWVFGGGTKLTVL

SEQ ID NO: 3549 - protein, 123 aa, Homo sapiens
QVQLVQSGAEVKKPGASVKVSCKVSGYTLIELSMHWVRQAPGKGLEWMGGFDPENVETIYAQKFQGRVTMTEDTSTDTAYMELSSLRSEDTAVYYCATGPALRTLEQTWFDPWGQGTLVTVSS

SEQ ID NO: 3550 - protein, 110 aa, Homo sapiens
QSVLTQPPSLSAAPGQKVTISCSGSSSNIGNNYVCWYQQLPGTAPKLLIYDNNKRPSGIPDRFSGSKSGTSATLGITGLQTGDEADYYCGTWDSSLRGGVFGGGTKLTVL

SEQ ID NO: 3551 - protein, 128 aa, Homo sapiens
QVQLQESGPGLVKPSQTLSLTCTVSGGSISSGSYYWSWIRQPAGKGLEWIGRIYTSGSTNYNPSLKSRVTMSVDTSKNHFSLKLRSVTAADTAVYYCARGIAVAGDDDYYYYYGLDVWGQGTTVTVSS

SEQ ID NO: 3552 - protein, 108 aa, Homo sapiens
SYELTQPPSVSVSPGQTARITCSGDALPKQYAYWYQQKPGQAPVMVINKDSERPSGIPERFSGSSSGTTVTLTISGVQAEDEADYYCHSADSSGTYWVFGGGTKLTVL

SEQ ID NO: 3553 - protein, 120 aa, Homo sapiens
QVQLVQSGAEVKKPGASVKVSCKASGYTFTNYYMHWVRQAPGQGLEWMGIINPSDDNTTYAQKIQGRVIMTRDTSTSTVYMELSSLRSEDTAVYYCARAFAEWELLLDYWGQGTLVTVSS

SEQ ID NO: 3554 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKVTVL

SEQ ID NO: 3555 - protein, 126 aa, Homo sapiens
QVQLVQSGAEVKKPGASVKVSCKASGYTFTGYYMHWVRQAPGQGLEWMGWINPNSDGTTYAQKFQGRVTMTRDTSISTAYMELSSLKSDDTAVYYCARGYGDYEDYYFYYYGMDVWGQGTTVTVSS

SEQ ID NO: 3556 - protein, 107 aa, Homo sapiens
DIQMTQSPFTLSASVGDRVTITCRASQSISSRLAWYQQKPGKAPKLLIYKASSLESGVPSRFSGSGSGTEFTLTISSLQPDDFATFYCQQYNSYPWTFGQGTKVEIK

SEQ ID NO: 3557 - protein, 122 aa, Homo sapiens
QLQLQESGPGLVKPSETLSLTCTVSGGSLSSSSYYWGWIRQPPGRGLEWIGSINYSGSTYYNPSLKSRVTISVDTSKNQFSLKLSSVTAADTAVYYCVGVRGLLILFWFDPWGQGTLVTVSS

SEQ ID NO: 3558 - protein, 111 aa, Homo sapiens
NFMLTQPHSVSESPGKTVTISCTGSSGSIASNYVQWYQQRPGSAPTALIYEDNQRPSGVPDRFSGSIDSSSNSASLTISGLKTEDEADYYCQSYDSSTLWVFGGGTKLTVL

SEQ ID NO: 3559 - protein, 128 aa, Homo sapiens
EVQLVESGGGLVQPGGSLRLSCAASGFTFSSYDMHWVRQAAGKGLEWVSVIGTAGDTYYPGSVKGRFTISRENAKNSLYLQMTSLRAGDTAVYYCARGVDTAMVRGGKLYYFYYMDVWGQGTTVTVSS

SEQ ID NO: 3560 - protein, 108 aa, Homo sapiens
DIQMTQSPSSLSASVGDRVTITCRASQSISSYLNWYQQKPGKAPKLLIYAASILQGGVPSRFSGSGSGTDFTLTISSLQPEDFATYYCQQSYVTPPVTFGPGTKVDIK

SEQ ID NO: 3561 - protein, 114 aa, Homo sapiens
EVQLVESGGGLVQPGGSLRLSCAGSGFTLSGNWMYWVRQVPGKGLVCVARINVDGSDTTYADSVKGRFTISRDDAKNTMYLQMNSLRAEDTAVYYCVIVRLGSWGQGTLVTVSS

SEQ ID NO: 3562 - protein, 109 aa, Homo sapiens
QAVVTQEPSLTVSPGGTVTLTCGLRTGAVTIGHNPYWFQQKPGQAPRTLIWDATHKFSWTPARFSGSLLGDKAALTLSGAQPEDEADYYCFFSYYGSAVFGGGTRLTVL

SEQ ID NO: 3563 - protein, 124 aa, Homo sapiens
QVQLQESGPGLVKPSETLSLTCTVSGGSISTYYWSWIRQPPGKGLEWIGYITYSGSTNYNPSLKSRVTISVDTSKNQFSLKLRSVTAADTAVYYCARGVVIAIPSYYYYGMDVWGQGTTVTVSS

SEQ ID NO: 3564 - protein, 109 aa, Homo sapiens
SYVLTQPPSVSLAPGKTARITCGGNNIGSKSVHWYQQKPGQAPVLVIYYDSDRPSGIPERFSGSNSGNTATLTISRVEAGDEADYYCQVWDSNSDHAVVFGGGTKLTVL

SEQ ID NO: 3565 - protein, 122 aa, Homo sapiens
QVQLVQSGAEVKKPGASVKVSCKVSGYTLIELSMHWVRQAPGKGLEWMGGFDPEDGETVYAQKFQGRVTMTEDTSTDTAYMELSSLRSEDTAVYYCATESPFPAAVGWFDPWGQGTLVTVSS

SEQ ID NO: 3566 - protein, 110 aa, Homo sapiens
QSALTQPASVSGSPGQSITISCTGTSSDVGGYNYVSWYQQHPGKAPKLMIYHVTKRPSGVANRFSGSKSGNTASLTISGLQAEDGADYYCSSYTSTSTRVFGGGTKLTVL

SEQ ID NO: 3567 - protein, 121 aa, Homo sapiens; identical to SEQ ID NO: 3283

SEQ ID NO: 3568 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPITFGGGTKVEIK

SEQ ID NO: 3569 - protein, 119 aa, Homo sapiens
QVTLRESGPALVKPTQTLTLTCTFSGFSLSTSGMCVSWIRQPPGKALEWLARIDWDDDKYYTTSLITRLTISKDTSKNQVVLTMTNMDPVDTATYYCSREARGVILDYWGQGTLVTVSS

SEQ ID NO: 3570 - protein, 107 aa, Homo sapiens
DIQMTQSPSSLSASVGDRVTIACRASQNIRSYLNWYQQSPGKAPKLLIFAASSLQSGVPSRFSGSGSGTDFTLTISSLQPEDFATYYCQQSFSTPRTFGQGTKVEIK

SEQ ID NO: 3571 - protein, 128 aa, Homo sapiens
QVQLVQSGAEVKKPGASVKVSCRVSGYTLTELSMHWVRQAPGKGLEWMGGFDPEKGETIYAQKFQGRVTMTEDTSTDTAYMELSSLRSEDTAVYYCATATAIQGVPTDYYYHYGMDVWGQGTTVTVSS

SEQ ID NO: 3572 - protein, 110 aa, Homo sapiens
QSALTQPASVSGSPGQSITLSCTGTSSDVGGYNYVSWCQQCPGKAPKLMIYDVSKRPSGVSHRFSGSKSGNTASLTISGLQAEDEADYYCFSYTSSSTYVFGTGTKVTVL

SEQ ID NO: 3573 - protein, 129 aa, Homo sapiens
EVQLVESGGGLVQPGRSLRLSCAASGFTFDDYAMHWVRQAPGEGLEWVSGISWNSGSIGYADSVKGRFTISRDNAKNSLYLQMNSLRAEDTALYYCAKDTRFSFGTIAAAVSGYGMDVWGQGTTVTVSS

SEQ ID NO: 3574 - protein, 108 aa, Homo sapiens
QSALTQPASVSGSPGQSITISCTGTSSDVGIFNLVSWYQQHPGKAPKLMIYEVTKRPSGVSNRFSGSKSGNTASLTISGLQAEDEADYYCCSYAGSYVFGTGTKVTVL

SEQ ID NO: 3575 - protein, 123 aa, Homo sapiens
EVQLVQSGAEVKKPGESLKISCKASGYSFTIYWIGWVRQMPGKGLEWMGVIYPGDSDTRYSPSFQGQVTISADKSISTAYLQWSSLKASDTAMYYCALGYHSGSYPFNWFDPWGQGTLVTVSS

SEQ ID NO: 3576 - protein, 106 aa, Homo sapiens
EIVMTQSPATLSVSPGERATLSCRASQSVSSNLAWYQQKPGQTPRLLIYGASTRATGIPARFSGSGSGTEFTLTISSLQSEDFAVYYCQQYDNLLTFGGGTKVEIK

SEQ ID NO: 3577 - protein, 124 aa, Homo sapiens
QVQLVQSGAEVKKPGASVKVSCKVSGYMLIELSMHWVRQAPGKGLEWMGGFDPEDAETMYAQNFQGRVTMTEDTSTDTAYMELSSLTSEDTAVYYCATAYAYCAGDCYRFVDYWGQGTLVTVSS

SEQ ID NO: 3578 - protein, 110 aa, Homo sapiens
QSALTQPASVSGSPGQSITISCTGTSSDVGGYNYVSWYQQHPGKAPKLMIYDVSKRPSGVSNRFSGSKTGNTASLTISGLQADDEADYYCSSFTSGSTLVFGGGTKLTVL

SEQ ID NO: 3579 - protein, 121 aa, Homo sapiens
QVQVVQSGAEVKKPGASVKVSCKVSGYTLTELSMHWVRQAPGKGLEWMGGFDPEDAETIYAQKFQGRVTMTEDTSTDTAYMELSSLRSEDTAVYYCATSPSVVVAATPYYWGQGTLVTVSS

SEQ ID NO: 3580 - protein, 110 aa, Homo sapiens
QSVLTQPPSASGTPGQRVTISCSGSSSNIGSKYVYWYQQLPGTAPKLLIYRNNQRPSGVPDRFSGSKSGTSASLAISGLRSEDEADYYCAAWDDSLSGPVFGGGTKLTVL

SEQ ID NO: 3581 - protein, 119 aa, Homo sapiens
EVQLVESGGGLVQPGGSLRLSCAASGFTFNNYWMTWVRQAPGKGLEWVANIKQDGSEKYYVDSVKGRFTISRDNAKKSLCLQMNSLRAEDTAVYYCARAFWFGGYFDLWGRGTLVTVSS

SEQ ID NO: 3582 - protein, 110 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSIWVFGGGTKLTVL

SEQ ID NO: 3583 - protein, 118 aa, Homo sapiens
QITLKESGPTLVKPTQTLTLTCTFSGFSLSTIGVGVGWIRQPPGKALEWLAVIYWDDDKRYSPSLKSRLTITKDTSKNQVVLTMTNMDPVDTATYFCTHVATADSDYWGQGTLVTVSS

SEQ ID NO: 3584 - protein, 107 aa, Homo sapiens
EIVMTQSPATLSVSPGERATLSCRASQTVSSNLAWYQQKPGQAPRLLIYAASTRATGIPARFSGSGSGTEFTLTISSLHSEDFALYYCQHYDNWPWTFGQGTKVDIK

SEQ ID NO: 3585 - protein, 115 aa, Homo sapiens
QVQLVQSGAEVKKPGASVKVSCKASGYTFSIYDINWVRQATGQGLEWLGWMSPNSGYTGYAQKFQGRVTMTRNTSITTAYMELSSLRSEDTAVYYCAIGTPSNRWGQGTLVTVSS

SEQ ID NO: 3586 - protein, 107 aa, Homo sapiens
DIQMTQSPSTLSSSVGDRVTITCRASQSISSWLAWYQQKPGKAPKLLIYKASSLDSAVPSRFSGSGSGTEFTLTISSLQPDDFATYYCQQYNSYSRTFGQGTKVEIK

SEQ ID NO: 3587 - protein, 124 aa, Homo sapiens
QVQLQESGPGLVKPSGTLSLTCAVSGGSISSSVYWSWVRQPPGKGLEWIGEIYHSGSSNYNPSLKSRVTISVDKSKNQFSLKLSSVTAADTAVYYCARIGPPSGSGSTRTFDYWGQGTLVTVSS

SEQ ID NO: 3588 - protein, 110 aa, Homo sapiens
QSALTQPASVSGSPGQSITISCTGTSSDVGSYNLVSWYQQLPGKAPKLMIYEVIKRPSGVSNRFSGSKSGNTASLTISGLQAEDEADYYCCSYAGSSTWVFGGGTKLTVL

SEQ ID NO: 3589 - protein, 119 aa, Homo sapiens
QVQLVQSGVEVKKPGASVKVSCKASGYTFTSYGISWVRQAPGQGLEWMGWISAYNGNTNYAQKFQGRVTMTTDTSTSTAYMELRSLRSDDTAVYYCARDFGELLPFDYWGQGTLVTVSS

SEQ ID NO: 3590 - protein, 106 aa, Homo sapiens
EIVLTQSPATLSLSPGERATLSCRASQSVNIYLAWYQQKPGQAPRLLIYDASDRATGIPPRFSGSGSGTDFTLTISSLEPEDFAVYYCQQRINGLTFGGGTKVEIK

SEQ ID NO: 3591 - protein, 120 aa, Homo sapiens
QLQLQESGPGLVKPSQTLSLTCTVSGGSISSGSYYWSWIRQPAGKGLEWIGSIYTSGSTYYNPSLKSRVTISVDTSKNQFSLKLSSVTAADTAVYYCARKNWLQGSFDYWGQGTLVIVSS

SEQ ID NO: 3592 - protein, 111 aa, Homo sapiens
NFMLTQPHSVSESPGKTVTISCTRSSGSIANNYVQWYQQRPGSAPTTVIYEDNQRPSGVPDRFSGSIDSSSNSASLTISGLKTEDEADYYCQSYDTSNHGVFGGGTKLTVL

SEQ ID NO: 3593 - protein, 123 aa, Homo sapiens
QVQLVQSGAEVKKPGASVKVSCKVSGYTLPELSMHWVRQAPGKGLEWMGGFDPEDGETIYAQEFQGRVTMTEDTSTDTAYMELSSLRSEDTAVYYCAITTPFGDHGPGWFHPWGQGTLVTVSS

SEQ ID NO: 3594 - protein, 108 aa, Homo sapiens
EIVLTQSPGTLCLSPGERATLSCRASQSVSSSYLAWYQQKPGQAPRLLIYGASSRAPGIPDRFSGSGSGTDFTLTISRLEPEDFAVYHCQQYGRPPLTFGGGTKVEIK

SEQ ID NO: 3595 - protein, 123 aa, Homo sapiens
QVQLVQSGAEVKKPGASVKVSCKVSGYTLVELSIHWVRQVPGKGLEWMGGFDPEDGETIYAQKFQGRVTMTEDTSTDTAYMELSSLRSEDTAVYYCATSPPMGRPLTHWFDPWGQGTLVTVSS

SEQ ID NO: 3596 - protein, 110 aa, Homo sapiens
QSVLTQPPSASGTPGQRVTISCSGSSSNIGSNTVNWYHQVPGTAPKLLIYNNHQRPSGVPDRFSGSKSGTSASLAISGLQSEDEADYYCAAWDDSLNGWVFGGGTKLTVL

SEQ ID NO: 3597 - protein, 121 aa, Homo sapiens
EVQVVESGGGLVQPGGSRRLSCTASGFTLRNYWMSWVRQAPGKGLEWVANIKQDGSEKYYVDSVKGRFTISRDNAKNSLYLQMDSLRAEDTAVYYCARGGRYCPGGSCPRWGRGTLVTVSS

SEQ ID NO: 3598 - protein, 108 aa, Homo sapiens
DIQMTQSPSSLSASVGDRVTITCQASQDISNFLNWYQLKPGEAPTLLIFDASKLETGVPSRFSGTGFGTDFTFTISSLQPEDTATYYCQQYDDLTSITLGQGTRLEIK

SEQ ID NO: 3599 - protein, 128 aa, Homo sapiens
EVQLVESGGGLVKPGGSLRLSCAASGFTFRSYSMNWVRQAPGKGLEWVSSISSTNSNIYYADSVKGRFTISRDNAKNSLYLQMNSLRAEDTAVYYCARDRYGGWPPIVYYYYYGMDVWGQGTTVTVSS

SEQ ID NO: 3600 - protein, 110 aa, Homo sapiens
QSVLTQPPSVSAAPGQRVTISCSGSNSNIGTNYVSWYQQLPGTAPKLLIYDNNKRPSGIPDRFSGSKSGTSATLGITGLQTGDEADYYCGTWDSSLSAGTFGGGTKLTVL

SEQ ID NO: 3601 - protein, 127 aa, Homo sapiens
QVQLQESGPGLVKPSGTLSLTCEVSGGSISSSNWWSWVRQPPGKGLEWIGDIYHSGSTNYNPSLKSRVTIAVDKSKNQFSLNLNSVTAADTAVYYCAREGVAVTGPHMFGYYGIDVWGQGTTVTVSA

SEQ ID NO: 3602 - protein, 108 aa, Homo sapiens
SSELTQDPAVSVALGQTVRITCQGDSLRTYYATWYQQKPGQAPVLVIYDKNNRPSGIPDRFSGSSSGNTASLTITGAQAEDEADYYCNSRDSSGNHLVFGGGTKLTVL

SEQ ID NO: 3603 - protein, 118 aa, Homo sapiens
EVQLVESGGGLVQPGGSLRLSCAASGFTFSSYWMHWVRQAPGKGLVWVSHINSDGSSTSYADSVKGRFTISRDNAKNTLYLQMNSLRAEDTAVYYCARGLRYFDLDVWGQGTTVTVSS

SEQ ID NO: 3604 - protein, 110 aa, Homo sapiens
QSVLTQPPSVSEAPRQRVTISCSGSSSNIGNNAVNWYQQLPGKAPKLLIFYDDLLPSGVSDRFSGSKSGTSASLAISGLQSEDEADYYCAAWDDSLNGGVFGGGTKLTVL

SEQ ID NO: 3605 - protein, 121 aa, Homo sapiens
QVQLVESGGGVVQPGRSLRLSCAASGFTFSTYALHWVRQGPGKGLEWVAVISYDGYNKYYADSVKGRFTISRDNSKNTLYLQMNSLRTEDTAVYYCARSAGGGYYNHYDPCGQGTLVTVSS

SEQ ID NO: 3606 - protein, 107 aa, Homo sapiens
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPHTFGQGTKLEIK

SEQ ID NO: 3607 - protein, 123 aa, Homo sapiens
QVQLVESGGGVVQPGRSLRLSCAASGFTFSSYAMHWVRQAPGKGLEWVAVISYDGRNKYYADSVKGRFTISRDTSKNTLYLQMNSLRTDDTAVYYCARVGGVGFWLRAWLDYWGQGTLVTVSS

SEQ ID NO: 3608 - protein, 110 aa, Homo sapiens; identical to SEQ ID NO: 3266

SEQ ID NO: 3609 - protein, 122 aa, Homo sapiens
EVQLVESGGGLVQPGGSLRLSCAASGFTFSSYWMHWVRQGPGKGLLWVSRINSDGSSTFYADSVKGRFTISRDNAKNTLYLQMNSLRAEDTAVYYCARVRGGNGDYGWFDPWGQGTLVTVSS

SEQ ID NO: 3610 - protein, 105 aa, Homo sapiens
SYVLTQPPSVSVAPGKTARITCGGDNIGSKSVHWYQQKPGQAPVLVIYYDSDRPSGIPERFSGSNSGNTATLTISRVEAGDEADYYCQVWDSTVVFGGGTKLTVL

SEQ ID NO: 3611 - protein, 123 aa, Homo sapiens
EVQLVESGGGVVQPGGSLRLSCAASGFTFHDYAMHWVRQAPGKSLEWVSLIIGDGGGTFYADSVKGRFTISRDNSKNSLYLQMNSLRTEDTALYFCAKDSSTVQGWVSWFDPWGQGTLVTVSS

SEQ ID NO: 3612 - protein, 108 aa, Homo sapiens
DIQMTQSPSSLSTSVGDRVTITCRASQSISSYLNWYQQKPGKAPKLLIYAASSLQSGVPSRFSGSGSGTDFTLTISSLQPEDFATYYCQQSYSTPPWTFGQGTKLEIK

SEQ ID NO: 3613 - protein, 120 aa, Homo sapiens
QVQLQESGPGLVKTSGTLSLTCAVSGGSISSSNWWSWVRQPPGEGLEWIGEIYHSGSTNYNPSLKSRVTISVDKSKNQFSLNLSSVTAADTAVYYCARPLIGVSSGGDYWGQGTLVTVSS

SEQ ID NO: 3614 - protein, 110 aa, Homo sapiens
QSVLTQPPSASGTPGQRVTISCSGSSSNIGSYAVTWYQQLPGTAPKLLIYSTNQRPSGVPDRFSGSKSGTSASLAISGLQSEDEADYYCAAWDDSLNGPVFGGGTKLTVL

SEQ ID NO: 3615 - protein, 125 aa, Homo sapiens
QVQLVESGGGVVQPGRSLRLSCAASGFTFSTYAMHWVRQAPGKGLEWVAVISYDGSKKYYADSVKGRFTISRDHSRNTLYLQMNSLRAEDTAVYYCARESSGYTSGWFTGTMDVWGQGTTVTVSS

SEQ ID NO: 3616 - protein, 107 aa, Homo sapiens
DIQMTQSPSSLSASVGDRVTITCRASQSISNSLNWYQQKPGKAPELLIYAASSLQSGVPSRFSGSGSGTDFTLTISSLQPEDFATYYCQQSYTSRLTFGGGTKVEIK

SEQ ID NO: 3617 - protein, 122 aa, Homo sapiens
QVQLVESGGGVVQPGRSLRLSCAASGFTFSNYPMHWVRQAPGKGLEWVAVISYDGSNKYYADSVKGRFTISRDNSKNTLYLHMNSLRGEDTALYYCARDGVTGSDSYGMDLWGQGTTVTVSS

SEQ ID NO: 3618 - protein, 110 aa, Homo sapiens
QSALTQPASVSGSPGQSITISCTGTSSDVGGYDYVSWYQQHPGKAPKLMIYDVSKRPSGVSNRFSGSKSGNTASLTISGLQGEDEADYYCGSYTSSSTWVFGGGTKLTVL

SEQ ID NO: 3619 - protein, 121 aa, Homo sapiens
QVQLVQSGAEVKKPGASVKVSCKVSGYTLPELSMHWVRQAPGKGLEWMGGFDPEDGETIYAQKFQGRVTMTEDTSTDTAYMELSSLRSEDTAVYYCATSAAILKVNWFDPWGQGTLVTVSS

SEQ ID NO: 3620 - protein, 112 aa, Homo sapiens
QSALTQPASMSGSPGQSITISCTGTSSDVGGYNSVSWYLQHPGKAPKLMIYDVSKRPSGVSNRFSGSKSGNTASLTISGLQAEDEGDYYCSSYTNSSTLCVVFGGGTKLTVL

SEQ ID NO: 3621 - protein, 117 aa, Homo sapiens
EVQLVESGGGLVQPGGSLRLSCAASGFTVSRNYMTWVRQAPGKGLEWVSIIYSGGSTYYADSVKGRFTISRDNSKNTLYLQMNSLRAEDTAVYYCARDTFHRGDVYWGQGTLVTVSS

SEQ ID NO: 3622 - protein, 108 aa, Homo sapiens
DIQMTQSPSSLSASVGDRVTITCQASQDINNYLNWYQQKPGKAPKLLIYDASNLETGVPSRFSGSGSGTDFTFTISSLQPEDIATYYCQQYGNLPPYTFGQGTKLEIK

SEQ ID NO: 3623 - protein, 120 aa, Homo sapiens
EVQLVESGGGLVQPGRSLRLSCAASGFTFDDYAMHWVRQAPGKGLEWVSGISWNSGSIDYADSVKGRFTISRDNAKNSLYLQMNSLRAEDTALYYCAKDHLGELSSPDYWGQGTLVTVSS

SEQ ID NO: 3624 - protein, 110 aa, Homo sapiens
QLVLTQSPSASASLGASVKLTCILSSGHSSYAIAWHQQQPEKGPRYLMKLNSDGSHSKGDGIPDRFSGSSSGAERYLTISSLQSEDEADYYCQTWGTEVVFGGGTKLTVL

SEQ ID NO: 3625 - protein, 117 aa, Homo sapiens
EVQVVESGGGLVQPGGSLRLSCAASGFTFSTYAMHWVRQAPGKGLEYVSGISSNGGSTYYANSLKGRFTISRDNSKNTLYLQMGSLRAEDMAVYYCARSTNRGFDPWGQGTLVTVSS

SEQ ID NO: 3626 - protein, 113 aa, Homo sapiens
DIVMTQSPDSLAVSLGERATIKCKSSQSVLYSSNNKNYLAWYQQKPGQPPKSLIYWASTRESGVPDRFSGSGSGTDFTLSISSLQAEDVAVYYCHQYYSSPYTFGQGTKLEIK

SEQ ID NO: 3627 - protein, 117 aa, Homo sapiens
EVQLVESGGGLVQPGGSLRLSCAASGFTVSSNYMSWVRQAPGKGLEWVSIIYSGGSTFYADSVKGRFTISRDSSKNTLYLQMSSLRAEDTAVYYCARDLDYYGMDVWGQGTTVTVSS

SEQ ID NO: 3628 - protein, 108 aa, Homo sapiens
DIQLTQSPSFLSAPVGDRVTITCRASQGISSYLAWYQQKPGKAPKLLIYGASTLQSGVPSRFSGSGSGTEFTLTISSLQPEDFATYYCQQLNSYQRFTFGPGTKVEIK

SEQ ID NO: 3629 - protein, 129 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGNRCSGGSCLNYYYFYGMDVWGQGTTVTVSS

SEQ ID NO: 3630 - protein, 111 aa, Homo sapiens
QSALTQPASVSGSPGQSITISCTGTGSDVGGYNYVSWYQQHPGKAPKLMIYDVSERPSGVSNRFSGSKSGNTASLTISGLQAEDEADYYCSSYTSSSTLDVFGGGTKLTVL

SEQ ID NO: 3631 - protein, 127 aa, Homo sapiens
EVQLVESGGGLVKPGGSLRLSCAASGFPFSSYTMNWVRQAPGKGLEWVSSISGSSNYIYYVDSVKGRFTISRDNAKNSLYLQINSLRAEDTAVYYCARSVRHYYDSSGYYPGAMDVWGQGTTVTVSS

SEQ ID NO: 3632 - protein, 108 aa, Homo sapiens
EIVMTQSPATLSVSPGERATLSCRASQSVSSNLAWYQQKHGQAPRLLIYGASTRATGIPARFSGSGSGTEFTLTISGLQSEDFAVYYCQQYYNWPPYTFGQGTKLEIK

SEQ ID NO: 3633 - protein, 121 aa, Homo sapiens
QVQLQESGPGLVKPSQTLSLTCTVSGGSINSGGYYWSWIRQHPGKGLEWIGYIYYSGTTYYNPSLKSRITISVDTSKSQFSLKLSSVTAADTAVYYCARVNFSRSWYFDYWGQGTLVTVSS

SEQ ID NO: 3634 - protein, 108 aa, Homo sapiens
QSALTQPRSVSGSPGQSVTISCTGTSSDVGGYNYVSWYQQHPGKAPKLMIYDVNKRPSGVPDRFSGSKSGNTASLTISGLQAEDEADYYCCSYAGSWVFGGGTKLTVL

SEQ ID NO: 3635 - protein, 125 aa, Homo sapiens
QVQLQESGPGLVKPSETLSLTCTVSGGSISSYYWSWIRQPPGKGLEWIGYIFYSGSTNYNPSLKSRVTISLDTSKNQFSLKLSSVTAADTAVYYCATQEYSSSSALGYYYGFDVWGQGTTVTVSS

SEQ ID NO: 3636 - protein, 106 aa, Homo sapiens
SYELTQPPSVSVSPGQTATITCSGDKLGDKYACWYQQKPGQSPVLVIYQDTKRPSGIPERFSGSNSGNTATLTISGTQAMDEADYYCQAWDSSTAVFGGGTKLTVL

SEQ ID NO: 3637 - protein, 121 aa, Homo sapiens
QVTLRESGPALVKPTQTLTLTCTFSGFSLSSSGMCVSWIRQPPGKALEWLARIDWDDDKYYSTSLQTRLTISKDTSKNQVVLTMTNMDPVDTATYYCARISAPAGLGIDPWGQGTLVTVSS

SEQ ID NO: 3638 - protein, 107 aa, Homo sapiens
DIQMTQSPSSLSASVGDRVTITCRASQSISSYLNWYQQKPGKAPKLLIYAASSLQSGVPSRFSGSGSGTDFSLTISNLQPEDFATYYCQQSYSTPYTFGQGTKLEIK

SEQ ID NO: 3639 - protein, 132 aa, Homo sapiens
QVQLQESGPGLVKPSQTLSLTCTVSGGSISSGDNYWSWIRQPPGKGLELIGYIYYSGTTYYKPSLKSRLTISVDTSKNQFSLNLSSVTAADTAVYYCARVGRTTTKYDFWRGTELQYYFDYWGQGTLVTVSS

SEQ ID NO: 3640 - protein, 108 aa, Homo sapiens
DIQMTQSPSSLSASVGDRVTITCRASQSISSYLNWYQQKPGKAPKLLIYAASNLQSGVPSRFSGYGSGSDFTLTISSLQPEDFATYYCQQSYSTPPWTFGQGTKVEIK

SEQ ID NO: 3641 - protein, 124 aa, Homo sapiens
QVQLVQSGAEVKKPGSSVKVSCKASGGTFSSYDISWVRQAPGQGLEWMGRITPILGIANYAQKFQGRVTINADKSTSTAYMELSSLKSEDTAVYYCARTRGYSGYGSLWYFDFWGQGTLVTVSS

SEQ ID NO: 3642 - protein, 111 aa, Homo sapiens
QSVLTQPPSVSGAPGQRVTISCTGNNSNIGAGYDVHWYQQLPRTAPKLLIYVNSNRPSGVPDRFSGSKSGTSASLAITGLQAEDEADYYCQSYDSSLSDLVFGGGTKLTVL

SEQ ID NO: 3643 - protein, 120 aa, Homo sapiens
QVQLVQSGAEVKKPGASVKVSCRISDYTLTELSIHWVRQAPGKGLEWMGGFDPEDGEIIYAQKFQGRVTMTEDTSTDTAYMELSSLRSEDTAVYYCATGGQWLVRWFDPWGQGTLVTVSS

SEQ ID NO: 3644 - protein, 110 aa, Homo sapiens
QSALTQPASVSGSPGQSITISCTGTSSDVGGYNYVSWYQQHPGKAPKLMIYDVTKRPSGVSNRFSGSKSGNTASLTISGLQAEDEADYYCSSYTSSNTLVFGGGTHLTVL

SEQ ID NO: 3645 - protein, 126 aa, Homo sapiens
QVQLVQSGAEVKKPGSSVKVSCKASGGTLSSYTISWVRQAPGQGLEWMGRIIPILGIADYAQKFQGRVTITADKSTTTAYMDLSSLGSEDTALYYCASAPKDWSSGFDYYYGMDVWGQGTMVTVSS

SEQ ID NO: 3646 - protein, 113 aa, Homo sapiens
DIVMTQTPLSLSVTPGQPASISCKSSQSLLNSDGKTYLYWYLQKAGQPPQLLIYEVSNRFSGVPERFSGSGSGTDFTLKISRVEAEDVGVYYCMQSVQLPPYTFGQGTKLEIT

SEQ ID NO: 3647 - protein, 119 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHHTITRINDYWGQGTLVTVSS

SEQ ID NO: 3648 - protein, 109 aa, Homo sapiens
QSALTQPASVSGSPGQSITISCTATSSDVGAYNYVSWYQQHPGKAPKLMIYDVSKRPSGVSNRFSGSKSGNTASLTISGLQAEDEADYYCSSYTSSSTVFGGGTKLTVL

SEQ ID NO: 3649 - protein, 121 aa, Homo sapiens
EVQLVESGGGLVQPGGSLRLSCAASGFTFSTYAMHWVRQAPGKGLEHVSGISSNGGSTYYANSVKGRFTISRDNSKNTLDLQMGSLRAEDMAVYYCARSLFLSGYVYFEYWGQGTLVTVSS

SEQ ID NO: 3650 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSANLGGVFGGGTKLTVL

SEQ ID NO: 3651 - protein, 121 aa, Homo sapiens
EVQLVESGGGLVQPGGSLRLSCAASGFTFSSYAMHWVRQAPGKGLEYVSGISSNGGSTNYANSVKGRFTISRDNSKNTLYLQMGSLRAEDMAVYYCARSLFLSGFVYFDTWGQGTLVTVSS

SEQ ID NO: 3652 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDGNNHGGVFGGGTKLTVL

SEQ ID NO: 3653 - protein, 127 aa, Homo sapiens
QVHLVESGGGVVQPGRSLRLSCAASGFTFSNYGMHWVRQAPGKGLEWVAVISADENNKFYASSVKGRFTISRDNSKNTLYLQMNSLRTEDTARYYCAKGGDNSGWAWDGDNPPTDYWGQGTLAIVSS

SEQ ID NO: 3654 - protein, 113 aa, Homo sapiens
DIVMTQSPDFLAVSLGERATINCKSSQSVFYTPKNKSYLAWYKQKPGQPPKVLFYWASTRESGVPERFSGSGSGTDFTLIISSLQAEDAAVYYCQQYYTAPLTFGGGTKVEIK

SEQ ID NO: 3655 - protein, 123 aa, Homo sapiens
EVQLLESGGGLVQPGGSLRLSCAASGFTFSSYVLSWVRQGPGRGLEWVSSISGSGGETYYADSVKGRFSISRDNSKNTLDLHMNSLRAEDTAVYFCARDRDWEALRSEYFDLWGRGTLVSVSS

SEQ ID NO: 3656 - protein, 107 aa, Homo sapiens
DIVLTQSPATLSLSPGERATLSCRASHFMHSNLAWYQQKLGQAPRLLIYDAASRAAGIPPRFRGSGSGTDFTLTISSLEPEDFAVYYCQQRSSWPRTFGGGTKVEIK

SEQ ID NO: 3657 - protein, 119 aa, Homo sapiens
EVQLVESGGGLVQPGGSLRLSCAATGFTFNNYWMTWVRQAPGKGLEWVASINQDGTEKYNVDSVKGRFTISRDNRKNSQYLQMNSLRAEDTAVYYCARVGIRSRSLTYWGQGNLVTVSS

SEQ ID NO: 3658 - protein, 107 aa, Homo sapiens
DIQMTQSPSSLSAFVGDRVTITCRTSQSISNYLHWYQQKPGKAPRLLIYGASSLQSGVPSRFSGSGSGTDFTLTISSLQPEDFATYYCQQTYSTLTTFGPGTKVDIK

SEQ ID NO: 3659 - protein, 125 aa, Homo sapiens
QVQLQESGPGLVKPSQTLSLTCTVSGGSISSGDYYWSWIRQPPGKGLEWIGYIYYSGSTYYNPSLKSRVTMSLDTSKNQFSLKLSSVTAADTAVYYCARGQIYDYRGSGWWFDPWGQGTLVTVSS

SEQ ID NO: 3660 - protein, 106 aa, Homo sapiens
EIVLTQSPATLSLSPGERATLSCRASQSVSNYLAWYQQKPGQAPRLLIYDAYNRATGIPARFSGSGSGTDFTLTISSLEPEDFAVYYCQQRSNWSTFGQGTRLEIK

SEQ ID NO: 3661 - protein, 118 aa, Homo sapiens
QVQLQESGPGLVKPSQALSLTCTVSGGSIRSGSYYWNWIRQPAGKGLEWIGRIYSSGSTSYNPSVKGRVTMSVDTSTNQVFLNLTSVAASDTAVYYCARARFTGMDVWGQGTPVTVSS

SEQ ID NO: 3662 - protein, 107 aa, Homo sapiens
DIQMTQSPSSLYASVGDRVTITCRASQTVSTYLNWYQQKSGKAPKLLLYAASTLQSGVPSRFSGSGSGTDFTLTISSLQPDDFATYYCQQSLTPPLTFGPGTKVDIK

SEQ ID NO: 3663 - protein, 130 aa, Homo sapiens
QVQLVESGGGVVQPGRSLRLPCAASGFTFSSYDMHWVRQAPGKGLEWVAVISYDGRNKFYADSVRGRFTISRDNSKNTLFLQMNSLRAEDTAVYYCARDLGIAATGISDDYFYFYGMDVWGQGTTVTVSS

SEQ ID NO: 3664 - protein, 108 aa, Homo sapiens
SYELTQPPSVSVSPGQTARITCSGDALPKQYAYWYQQKPGQTPVLVIYKDSERPSGIPERFSGSSSGTTVTLTISGVQAEDEADYYCQSADSSGTYRVFGGGTKLTVL

SEQ ID NO: 3665 - protein, 124 aa, Homo sapiens
QVQLQESGPGLVKPSETLSLTCTVSGGSISSYSWTWIRQPPGQGLEWIGYIFYSGSTNYNPSLKSRVTISLDTPKNQFSLRLSSVTAADTAVYYCASVGGVEMATISFYGMDVWGQGTTVTVSS

SEQ ID NO: 3666 - protein, 106 aa, Homo sapiens
SYELTQPPSVSVSPGQTASITCSGDRLGDKYACWYQQKPGQSPVLVIYQDNKRPSGIPERFSGSNSGNTATLTISGTQAMDEADYHCQAWDSSNVVFGGGTKLTVL

SEQ ID NO: 3667 - protein, 121 aa, Homo sapiens
QVQLVESGGGVVQPGRTLRLSCAASGFAFSSYAMHWVRQAPGKGLEWVAVISSDESNKYYADSVKGRFTISRDNSKSTLYLQVNTLRPEDTAVYYCARDRLGIVAPRPDYWGQGTLVTVSS

SEQ ID NO: 3668 - protein, 108 aa, Homo sapiens
DIQMTQSPSSLSASVGDRVTITCQASQDISNYLNWYQQKPGKAPKLLIYDASNLETGVPSRFSGSGSGKDFTFTISSLQPEDIATYYCQQYDNLPPFTFGPGTKVDIK

SEQ ID NO: 3669 - protein, 122 aa, Homo sapiens
QVTLRESGPALVKPTQTLTLTCTFSGFSLSTSGMCVSWIRQPPGKALEWLARIDWDDDKYYSTSLKTRLTISKDTSKNQVVLTMTNMDPVDTATYYCARIGIGWFRWGMDVWGQGTTVTVSS

SEQ ID NO: 3670 - protein, 110 aa, Homo sapiens
QSALTQPASVSGSPGQSITISCTGTSSDVGGYNYVSWYQQHPGKAPKLMIYDVSKRPSGVSNRFSGSKSGNTASLTISGLQAEDEADYYCSSYTSSSTWVFGGGTKLTVL

SEQ ID NO: 3671 - protein, 121 aa, Homo sapiens
QVQLVQSGAEVKKPGASVKVSCKASGFPFTSYGLSWVRQAPGQGLEWMGWISGYNGNTHYAQKLQGRVTMSTDTSTSTAHMELRNLRSDDTAVYYCARQEGYFDWLYFANWGQGTLVTVSS

SEQ ID NO: 3672 - protein, 110 aa, Homo sapiens
QSVLTQPPSVSAAPGQKVTISCSGSNSNIGNSYVSWYQQLPGTAPKVLIYDNNKRPSGIPDRFSGSKSGTSGTLGITGLQTGDEAEYYCATWDSSLSAVVFGGGTKLTVL

SEQ ID NO: 3673 - protein, 121 aa, Homo sapiens
QVQLVESGGGVVQPGRSLRLSCAASGFTFSTYAIHWVRQAPGKGLEWVAVISYDGSNKYYAKSVKGRFTISRDNSKNTLYLQMNSLGAEDTAVYYCARAQFGNYYYGMDVWGQGTTVTVSS

SEQ ID NO: 3674 - protein, 109 aa, Homo sapiens
QSALTQPASVSGSPGQSITISCTGTSSDVGGYNYVSWYQQHPGKAPKLMIYDVSKRPSGVSNRFSGSKSGNTASLTISGLQAEDEADYYCSSYTSTFYVFGTGTKVTVL

SEQ ID NO: 3675 - protein, 125 aa, Homo sapiens
QVQLVESGGGVVQPGRSLRLSCTASGFTFSTYAIDWVRQAPGRGLEWVAVISHDGGNKYYADSVKGRFTISRDNSKNTLYLQMNSLRAEDTAVYYCARELRWAVPSWDGGYFDYWGQGTLVTVSS

SEQ ID NO: 3676 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYNTPPYTFGQGTKLEIK

SEQ ID NO: 3677 - protein, 127 aa, Homo sapiens
EVQLVESGGGVVQPGGSLRLSCAASGFTFDDYAMHWVRQAPGKGLEWVSLISGNGVSTYYADSVKGRFTISRDNSKNSLYLQMNSLRTEDTALYYCARDTGGVYAALYYYYYGMDVWGQGTTVTVSS

SEQ ID NO: 3678 - protein, 110 aa, Homo sapiens
QSVLTQPPSASGTPGQRVTISCSGSNSNIGSNTINWYQQLPGTAPKLLIYSNNQRPSGVPDRFSGSKSGTSASLAISGLQSEDEADYYCAAWDDSLNGVVFGGGTKLTVL

SEQ ID NO: 3679 - protein, 132 aa, Homo sapiens
QVQLVQSGAEVKTPGASVKVSCKVSGYTLTELSMHWVRQAPGKGLEWMGGFDPEDAETIYAQKFQGRVTMTEDTSTDTAYMELSSLRSEDTAVYYCATAPPIVGVPGAINRDYYYYYGMDVWGQGTTVTVSS

SEQ ID NO: 3680 - protein, 112 aa, Homo sapiens
DIVMTQTPLSSPVTLGQPASISCRSSQSLVHSDGNTYLSWLQQRPGQPPRPLIYKISNRFSGVPDRFSGSGAGTDFTLKISRVEAEDVGVYYCMQATQFPYTFGQGTKLEIK

SEQ ID NO: 3681 - protein, 132 aa, Homo sapiens
QVTLRESGPALVKPTQTLTLTCTFSGFSLSTSGMCVSWIRQPPGKALEWLARIDWDDDKYYSTSLKTRLTISKDTSKNQVVLTMTNMDPVDTATYYCARINAAVPGRPWGYDKLSYYGMDVWGQGTTVTVSS

SEQ ID NO: 3682 - protein, 109 aa, Homo sapiens
EIVLTQSPGTLSLSPGERATLSCRASQSVSSGYLAWYQQKPGQAPRLLIYGASSRATGIPDRFSGSGSGTDFTLTISRLEPEDFAVYFCQQYGSSPLYTFGQGTKLEIK

SEQ ID NO: 3683 - protein, 122 aa, Homo sapiens
QVQLVQSGAEVKKPGASVKVSCKVSGYTLPELSIHWVRQAPGQGLEWLGGFDPEDGETIYAQKFQGRVTMTEDTSTDTAYMELSSLRSEDTAVYYCATAPPIAAAGTWFDPWGQGTLVTVSS

SEQ ID NO: 3684 - protein, 111 aa, Homo sapiens
QSVLTQPPSASGTPGQRVTISCSGSSSNIGTNYVYWYQQLPGTAPKLLIYNNNQRPSGVPDRFSGSKSGTSASLAISGLRSEDEADYYCAAWDDSLTGRYVFGTGTKVTVL

SEQ ID NO: 3685 - protein, 126 aa, Homo sapiens
QVQLQESGPGLVKPSETLSLTCTVSGDSISNYYWSWIRQPAGKGLEWIGRIYASGSTNYNPSLKSRVTMSLDTSKNHFSLKLSSVTTADTAVYYCAKDAVLYYFGSGSYSNWFDPWGQGTLVTVSS

SEQ ID NO: 3686 - protein, 112 aa, Homo sapiens
QSVLTQPPSVSGAPGQRVTISCTGSSSNIGAGYDVHWYQQLPGTAPKLLIYANGNRPSGVPDRFSGSKSGTSASLAITGLQAEDEADYYCQSYDSSLSGSRVFGGGTKLTVL

SEQ ID NO: 3687 - protein, 127 aa, Homo sapiens
EVQLVESGGGLVKPGGSLRLSCEASGFSFSTYSMNWVRQAPGKGLEWVSSTSSSSSHIYYADSVKGRFSISRDNAKNSLYLQMNSLRAEDTAVYYCARDYRRYSGSHSAPWHAFDIWGQGTMVTVSS

SEQ ID NO: 3688 - protein, 112 aa, Homo sapiens
EIVMTQTPLSLSVTPGQPASISCKSTQSLLHSDGKTYLYWYLQKAGQPPQLLIYEVSNRFSGVPDRFSGSGSGTDFTLKISRVEAEDIGVYYCMQSIQLPGTFGQGTKLEIK

SEQ ID NO: 3689 - protein, 122 aa, Homo sapiens
EVQLLESGGGSAQPGGSLRLSCAASGFIFSRYAMSWVRQAPGKGLEWISGISGGGDSTYNADSVKGRFTISRDNSKNTLYLQMSSLRVEDTAVYYCAKDDREDKSWGYPEYWGQGTLVTVSA

SEQ ID NO: 3690 - protein, 112 aa, Homo sapiens
QVVLTQSPSASASLGASVKLTCTLSSGHSSYAIAWHQQQPEKGPRFLMKLNGDGSHRDGDGLPDRFSGSSSGAERYLTISSLQSEDEADYYCQTWGTAYGGVFGGGTKLTVL

SEQ ID NO: 3691 - protein, 121 aa, Homo sapiens
QVQLVQSGAEVKKPGASVKVSCKVSGYTLIELSMHWVRQAPGKGLEWMGGFDPEVSETIYAQKFQGRVTMTEDTSTDTAYMELSSLRSEDTAVYYCAIAPAMVTTGWFDPWGQGTLVTVSS

SEQ ID NO: 3692 - protein, 110 aa, Homo sapiens
QSALTQPASVSGSPGQSITISCTGASSVVGAYNFVSWYQQHPGKAPKLMVYHVSERPSGVSHRFSGSKSGNTASLTISGLQAEDEADYYCSSYTGSSTWVFGGGTKLTVL

SEQ ID NO: 3693 - protein, 124 aa, Homo sapiens
QVQLVQSGAEVKKPGSSVKVSCKASGGTFSSYAISWVRQAPGQGLEWMGRIIPILGIPNYAQKFQGRVTITADKSTSTAYMELSSLRSEDTAVYYCALVAPADAYSYYYAMDVWGQGTTVTVSS

SEQ ID NO: 3694 - protein, 107 aa, Homo sapiens
QSVLTQPPSASGTPGQRVTISCSGSSSNIGSNYVYWYQQLPGTAPKLLIYSNNQRPSGVPDRFSGSRSATSASLAISGLRSEDEAAYYCAVWDDSLVFGGGTKLTVL

SEQ ID NO: 3695 - protein, 121 aa, Homo sapiens
QVQLVESGGGVVQPGRSLRLSCAASRFTFNSYAMHWVRQAPGKGLEWVAVISYDGSNKYYADSVKGRFTISRDNSKNTLYLQMNSLRAEDTAVYYCARDGSGSYWGPVDYWGQGTQVTVSS

SEQ ID NO: 3696 - protein, 108 aa, Homo sapiens
EVVLTQSPATLSLSPGERATLSCRASQSVSSYLGWFQQKPGQAPRLLIYDASNRATGIPARFSGSGSGTDFTLTISSLEPEDFAVYFCQQRSNWPPITFGQGTRLEIK

SEQ ID NO: 3697 - protein, 125 aa, Homo sapiens
QVQLQESGPGLVKPSETLSLTCTVSGGSISSYYWSWIRQPPGKGLEWIGYVYYSGSTNYNPSLKSRVTMSVDTSKNQFSLKLSSVTAADTAVYYCAGDFWSDYGGAYYYFGMDVWGQGTTVTVSS

SEQ ID NO: 3698 - protein, 107 aa, Homo sapiens
DIQMTQSPSSVSASVGDRVTITCRASQGISSWLAWYQQKPGKAPKLLIYAASTLQSGVPSRFSGSGSGTDFTLTISSLQPEDFATYYCQQTNSFPRTFGQGTKLEIK

SEQ ID NO: 3699 - protein, 125 aa, Homo sapiens
QVQLVQSGAEVKKPGASVTVSCKVSGFTLTELSIHWVRQAPGKGLEWMGGFDPEDGETIYAQKFQGRVTMTEDTSTDTAYMELSSLRSEDTAIYYCVTHRGMGIAARHYNWFDPWGQGTLVIVSS

SEQ ID NO: 3700 - protein, 110 aa, Homo sapiens
QSVLTQPPSVSAAPGQKVTISCSGTSSNIGNDYVSWYQHLPGTAPKLLIYDNNKRPSGIPDRFSGSKSGTSGTLGITGLQTGDEAEYYCATWDSSLSAVLFGGGTKLTVL

SEQ ID NO: 3701 - protein, 125 aa, Homo sapiens
EVQLVESGGGLVKPGGSLRLSCAASGFMFSSYSMNWVRQAPGKGLEWVSYISSSSSYIYYADSVKGRFTISRDNAKNSLYLQMNSLRAEDTAVYYCAGDQGVGGTYNYYYGMDVWGQGTTVTVSS

SEQ ID NO: 3702 - protein, 106 aa, Homo sapiens
SYELTQPPSVSVSPGQTASITCSGDKLGDKYVSWYQQKPGQSPVLVIYQDTKRPSGIPERFSGYNSGNTATLTISGTQAMDEADYYCQAWDSSHVVFGGGTKLTVL

SEQ ID NO: 3703 - protein, 123 aa, Homo sapiens
QVQLVQSGAEVKKPGASVKVSCKVSGYTLPELSMHWVRQAPGKGLEWMGGFDPEDGDTIYAQRFRGRVTMTEDTSTDTAYMELSSLRSDDTAVYYCTTTTPFGDHGPGWFDPWGQGTLVTVSS

SEQ ID NO: 3704 - protein, 107 aa, Homo sapiens
DIQMTQSPSSVSASVGDRVTITCRASQGPSNYIGWYQQKPGKAPKLLIYAASTLQTGVPSRFSGSGSGTDFTLTISSLQPEDFGTYYCQQGKNFPLTFGPGTKVDIK

SEQ ID NO: 3705 - protein, 119 aa, Homo sapiens
QVQLQESGPGLVKPSGTLSLTCVVSGGSISSSNWGWVRQPPGKGLEWIGEIYLSGTTNYNPSLTSRVTISVDKSKNQFSLKLNSMTAADTAIYYCARPTAGAGGAFDIWGQGTMVTVSS

SEQ ID NO: 3706 - protein, 110 aa, Homo sapiens
QSVLTQPPSASGTPGQRVTISCSGSNSKIGVYSVNWYQQLPGTAPKLLIYRNSQRPSGVPDRFSGSKSGTSASLAISGLQSEDEADYYCSVWDDSLNGPLFGGGTKLTFL

SEQ ID NO: 3707 - protein, 120 aa, Homo sapiens
EVQLVESGGGVVQPGGSLRLSCAASGFTFNDYAMHWVRQPPGKGLEWVSLISGDGDNTYYADSMKGRFTISRDNSKNSLYLQMNSLRTEDTAFYYCTTLYIWGIRPGDFWGQGTLVTVSS

SEQ ID NO: 3708 - protein, 111 aa, Homo sapiens
DVVMTQSPLSLPVTLGQPASISCRSSQSLVYTDGNTYLNWFQQRPGQSPRRLIYKVSNRDSGVPDRFSGSGSGTDFTLKISRVEAEDVGVYYCMQGTHWYTFGQGTKLEIK

SEQ ID NO: 3709 - protein, 126 aa, Homo sapiens
QVQLQESGPGLVKPSQTLSLTCTVSGDSISSGSFYWSWIRQPAGKGLEWIGRIYSSGSTDYNPSLKSRVTISGDTSKNQFSLKLTSVTAADTAVYYCARESVDYSQYYYYNGMDVWGQGTTVIVSS

SEQ ID NO: 3710 - protein, 110 aa, Homo sapiens
EIVLTQSPGTLSLSPGERATLFCRASEIVSSSYLAWYQQKPGQAPRLLIYGASSRATGIPDRFSGSGSGTDFTLTIIRLEPEDFAVYYCQQYGSSPPELTFGPGTKVDIK

SEQ ID NO: 3711 - protein, 131 aa, Homo sapiens
HVQLVESGGGVVQPGRSLRLSCAASGFTFSSYAMHWVRQAPGKGLEWVAVISYDGYNKYYADSVKGRFTISRDNSKNTLYLQMNSLRAEDTAIYYCARGQRGSGYSHLEGLTYYYHGMDVWGQGTTVTVSS

SEQ ID NO: 3712 - protein, 112 aa, Homo sapiens
DIVMTQSPLSLPVTPGEPASISCRSSQSLLYSNGYNYLDWYLQKPGQSPQLLIYLGSNRASGVPDRFSGSGSGTDFTLKISRVEAEDVGVYYCMQALQTPYTFGQGTKLEIK

SEQ ID NO: 3713 - protein, 127 aa, Homo sapiens
EVQLVESGGGLVKPGGSLRLSCAASGFTFSSHIMNWVRQAPGKGLEWVSSISTSSNYIYYVDSLKGRFTISRDNAKNSLYLQMNSLRAEDTAVYYCARSVRHYYDSTGYYPGAMDVWGQGTTVTVSS

SEQ ID NO: 3714 - protein, 108 aa, Homo sapiens
EIVMTQSPATLSVSPGERATLSCRASQSVSSNLAWYQQKPGQAPSLLIYGASTRATGIPARFSGSGSGTEFTLTISSLQSEDFAVYYCQHYYNWPPYTFGQGTKLEIK

SEQ ID NO: 3715 - protein, 122 aa, Homo sapiens
EVQLLESGGGLVQPGGSLRLSCAASGFTFSSYGMSWVRQAPGKGLEWVSTISGSGGSTYYADSVKGRFTISRDNSKKTLYLQMNSLRPEDTAVYYCAKLTFGDLERLGWDYWGQGTLVTVSS

SEQ ID NO: 3716 - protein, 112 aa, Homo sapiens
NFMLTQPHSVSESPGKTVTISCTGSSGSIASNYVQWYQQRPGSAPTTVIFEDNQRPSGVPDRFSGSIDSSSNSASLTISGLKTEDEADYYCQSYDGYNSGAVFGGGTKLTVL

SEQ ID NO: 3717 - protein, 125 aa, Homo sapiens
EVQLVESGGGLVQPGGSLRLSCAASGFTFSSYWMSWVRQPPGKGLEWVANIRQDGSEKHYADSMKGRFTISRDNAKNSLYLQMNSLRAEDTAVYYCTRDFRYSSGSYFDFVRGYWGQGTLVTVSS

SEQ ID NO: 3718 - protein, 111 aa, Homo sapiens
QSVLTQPPSVSGAPGQRVTISCTGSSSNIGAPYDVHWYQQLPGTAPKLLIYNNTNRPSGVPDRFSGSKSGTSASLAITGLQAEDEADYYCQSYDSSLSGWVFGGGTKLTVL

SEQ ID NO: 3719 - protein, 117 aa, Homo sapiens
EVQLVESGGGMVQPGRSLRLSCTASGFSFGDFAMSWVRQAPGKGLEWVGFIRSKAKGGTTEYAASVKGRFTISRDDSKSVAYLQMNSLKAEDTALYYCKNADASQYWGQGTLVTVSS

SEQ ID NO: 3720 - protein, 113 aa, Homo sapiens
DIVMTQSPDSLAVSLGERTTISCKSSQSVLHSSNNKNYLAWYQQKPGQPPKLLIYWASTRDSGVPDRFSGSGSGTDFTLTISSLQAEDVAVYYCQQHYSTPRTFGQGTKVEIK

SEQ ID NO: 3721 - protein, 123 aa, Homo sapiens
QLQLQESGPGLVKPSETLSLTCTVSGGSISSTSYYWAWIRQPPGKGLEWIGSIYYSGSTFYNPSLKSRVTISVDTSKNQFSLRLTSVTAADTAVYYCATFFRQWLADEGFDYWGQGTLVTASS

SEQ ID NO: 3722 - protein, 107 aa, Homo sapiens
DIQMTQSPSSLSASVGDSVTITCRASQGIRNDLGWYQQKPGKAPKRLIYAASSLQNGVPSRFSGSGSGTEFTLTISSLQPEDFATYYCLQYNSYPITFGQGTRLEIK

SEQ ID NO: 3723 - protein, 122 aa, Homo sapiens
QVQLVQSGAEVKKPGASVKVSCKVSGYTLIELSMHWVRQAPGKGLEWMGGFDPEDGETIYAQKFQGRVTMTEDTSTDTAYMELSSLRSEDTAVYYCATEWAYYGSGSYLGYWGQGTLVTVSS

SEQ ID NO: 3724 - protein, 107 aa, Homo sapiens
EIVMTQSPATLSVSPGERATLSCRASQSVSSNLAWFQQKPGQAPRLLIYGASTRVTVIPARFSGSGSGTEFTLTISSLQSEDFAVYYCQQYNNWPRTFGQGTKVEIK

SEQ ID NO: 3725 - protein, 125 aa, Homo sapiens
EVQLVESGGGLVQPGGSLRLSCAASGFTVSSNYMSWVRQAPGKGLEWVSVIYSGGSTHYADSVKGRFTISRDNSKNTLYLQMNILRAEDTAVYYCARATPYCGGDCSFGDAFDIWGQGTMVTVSS

SEQ ID NO: 3726 - protein, 106 aa, Homo sapiens
DIQMTQSPSTLSASVGDRVTITCRASQSLSSWLAWYQQKPGKAPKLLIYKASSLESGVPSRFSGSGSGTEFTLTINSLEPDDFATYYCQQYNSYWTFGQGTKVEIK

SEQ ID NO: 3727 - protein, 117 aa, Homo sapiens
QVQLVQSGSELKKPGASVKVSCKASGYTFTRYVMNWVRQAPGQGLEWMGWINTNTGNPTYAQGFTGRFVFSLDTSVSTAYLQISSLKAEDTAVYYCARVQRLIPSYWGQGTLVTVSS

SEQ ID NO: 3728 - protein, 107 aa, Homo sapiens; identical to SEQ ID NO: 1122

SEQ ID NO: 3729 - protein, 118 aa, Homo sapiens
QVQLVQSGAEVKKPGASVKVSCEASGYTFTSYGISWVRRAPGQGLEWMGWISAYNGNTNYAQKFQGRVTMTTDTSTSTAYMELRSLRSDDTAVYYCARDNYLDWFDPWGQGTPVTVSS

SEQ ID NO: 3730 - protein, 107 aa, Homo sapiens
EIVLTQSPDFQSVTPQEKVTITCRASQSIGSTLHWYQQKPDQSPKLLIKYASQSISGVPSRFSGSGSGTDFTLTINSLEAEDAATYYCHQSSSLPPTFGQGTKLEIK

SEQ ID NO: 3731 - protein, 121 aa, Homo sapiens
QVQLVESGGGVVQPGRSLRLSCAASGFTFSSYAMHWVRQAPGKGLEWVAVISYDGSNKYYADSVRGRFTISRDNSKNTLYLQMNSLRAEDTAVYYCARDHSGSYWGAFDYWGQGTLVTVSS

SEQ ID NO: 3732 - protein, 109 aa, Homo sapiens
SSELTQDPAVSVALGQTVRITCQGDSLRSYYASWYQQKPGQAPVLVIYGKNNRPSGIPDRFSGSSSGNTASLTITGAQAEDEADYYCKSRDSSGNHPAVFGGGTKLTVL

SEQ ID NO: 3733 - protein, 126 aa, Homo sapiens
QVHLVQSGAEVKKPGASVKVSCKASGYTFTNYGISWVRQAPGQGLEWMGWISGHNGNTNYAQKLQGRVTMTTDTSTSTAYMELRSLRSDDTAVYYCARDPEPTDPTIYGLGGFDYWGQGTLVIVSS

SEQ ID NO: 3734 - protein, 107 aa, Homo sapiens
DIQMTQSPSSLSASVGDRVTITCRASQSISSYLNWYQQKPGKAPKLLIYGASSLKSGVPSRFSGSGSGTDFSLTISSLQPEDFATYYCQQSYSAPRTFGQGTKVEIK

SEQ ID NO: 3735 - protein, 121 aa, Homo sapiens
EVQLVQSGAEVKKPGESLKISCKRSGYSFTTYWIGWVRQMPGKGLEWMGSIYPGDSDTRYSPSFQGQVTISADKSISTAYLQWSSLKASDTAMYYCASQEVPGYYYYMDVWGKGTTVTVSS

SEQ ID NO: 3736 - protein, 108 aa, Homo sapiens
DIQMTQSPSSLSASVGDRVTITCRASQSISSYLHWYQQKPGKAPKLLIYAASSLQSGVPSRFSGSGSGTDFTLTISSLQPEDFATYYCQQTYSTHTWTFGQGTKVEIK

SEQ ID NO: 3737 - protein, 123 aa, Homo sapiens
QITLKESGPTLVKPTQTLTLTCTFSGFSLSTSRVGVGWIRQPPGKALEWLALIYWNDGKLYSPSLKSRLTITKDTSKNQVVLTLTNMDSVDTATYFCARGQTGTPLYDAFDFWGRGTMVTVSS

SEQ ID NO: 3738 - protein, 109 aa, Homo sapiens
SYVLTQPPSVSVAPGKTAGITCGGDNFETKSVSWYQHKPGQAPVLVVYGNANRPSGIPERFSASKSGNTATLTISRVEAGDEADYYCQVWDSRSFHYVVFGGGTKLTVL

SEQ ID NO: 3739 - protein, 131 aa, Homo sapiens
QVQLQESGPGLVKPSQTLSLTCTVSGGSISSGSNYWTWIRQPAGKGLEWIGRIYTSGSTNYNPSLKSRGTISVDTSKNQFSLKLSSVTAADTAVYYCARGGVPGAIKDIVVVVAAGVFDIWGQGTRVTVSS

SEQ ID NO: 3740 - protein, 107 aa, Homo sapiens
EIVMTQSPATLSVSPGERATLSCRASQSVSSNLAWYQQKPGQAPRLLIYGASTRATGIPIRFSGSGSGTEFTLTISSLQSEDFAVYYCQQYNNWLWTFGQGTKVEIK

SEQ ID NO: 3741 - protein, 126 aa, Homo sapiens
EVQLVESGGGLVQPGGSLRLSCAASGFTFSSYDMHWVRQATGKGLEWVSAIGTAGDTYYPGSVKGRFTISRENAKNSLYLQMNSLRAGDTAVYYCARVKYSSSSRRDYYYYYMDVWGKGTTVTVSS

SEQ ID NO: 3742 - protein, 108 aa, Homo sapiens
DIQMTQSPSSLSASVGDRVTITCRASQSISSYLNWYQQKPGKAPKLLIYAASSLQSGVPSRFSGIGSGTDFTLTISSLQPEDFATYYCQQSYSAPGYTFGQGTKLEIQ

SEQ ID NO: 3743 - protein, 124 aa, Homo sapiens
EVQLVESGGDLVQPGRSLRLSCAASGFTFDDYALHWVRQAPGKGLEWVSGISWNGGIINYADSVKGRFTISRDNAKNSLYLQMIRLRPEDTALYYCAKSNCGGDCYSRIGFDYWGQGTLVTVSS

SEQ ID NO: 3744 - protein, 108 aa, Homo sapiens
SYVLTQPPSVSVAPGKTARITCGGKNIGSKSVHWYQQKPGQAPVLVVYDDSDRPSGIPERFSGSNSGNTATLTISRVEAGDEADYYCQVWDSSSDLVVFGGGTKLTVL

SEQ ID NO: 3745 - protein, 124 aa, Homo sapiens
EVQLLESGGGLVQPGGSLRLSCAASGFTFTNYAMSWVRQAPGKGLEWVSTISGSGGSTYYADSVKGRFTISRDNSKNTLYLHMNSLRAEDTAVYYCAKNERIIMIVVVTLFDYWGQGTLVTVSS

SEQ ID NO: 3746 - protein, 110 aa, Homo sapiens
QSVLTQPPSVSAAPGQRVTISCSGSSSNIGKNYVSWYQQLPGTAPKLLIYDNNKRPSGIPDRFSGSKSGTSATLGITGLQAGDEADYYCGTWDSSLSAGVFGGGTKLTVL

SEQ ID NO: 3747 - protein, 124 aa, Homo sapiens
QVQLVQSGAEVKKPGSSVKVSCKASGGTFSSYGINWVRQAPGQGLEWMGGIIPIFRTANYAQKFQGRVTIIADESTSTAYMELRSLRSEDTGVYYCARVEGEGVDFYHYGMDVWAQGTTVTVSS

SEQ ID NO: 3748 - protein, 108 aa, Homo sapiens
SSELTQPPSVSVSPGQTARITCSADTLPKQYAYWYQQKPGQAPVLVIYKDSERPSGIPERFSGSSSGTTVTLTISGVQAEDEADYYCQSADSSGTYVLFGGGTKLTVL

SEQ ID NO: 3749 - protein, 119 aa, Homo sapiens
QVQLVESGGGVVQPGRSLRLSCAASGFTFSIYSMHWVRQAPGKGLEWVAVISYDGSNKYYADSVKGRFTISRDNSKNTLYLQMNSLRAEDTALYYCARSSGYYPPYDYWGQGTLVTVSS

SEQ ID NO: 3750 - protein, 109 aa, Homo sapiens
SSELTQDPAVSVALGQTVRITCQGDSLRSYYASWYQQKPGQAPVLVIYDKNNRPSGIPDRFSGSSSGNTASLTITGAQAEDEADYYCHSRDSSGNRLGVFGGGTKLTVL

SEQ ID NO: 3751 - protein, 118 aa, Homo sapiens
QVQLQQWGAGLLKPSETLSLTCAVYGGSFSGYYWTWIRQPPGKGLEWIGEINPSGSTNYNPSLKSRVTISLDTSNNQFSLKLTSVTAADTAVYYCARRPWLRGTFDYWGQGTLVTVSS

SEQ ID NO: 3752 - protein, 112 aa, Homo sapiens
NFMLTQPHSVSESPGKTVTISCTGSSGSIASNYVQWYQQRPGSAPTTVMYEDNQRPSGVPDRFSGSIDSSSNSASLTISGLKTEDEADYYCQSYDSSSQGVIFGGGTKLTVL

SEQ ID NO: 3753 - protein, 124 aa, Homo sapiens
EVQLLESGGRLVQPGGSLRLSCAASGFTFSSYAMNWVRQAPGKGLEWVSAISGSGGDTDYVDSVKGRFTISRDNSKNTLYLQMNSLRADDTAVYYCAKGHMGRLVGATWAFDYWGQGTLVTVSS

SEQ ID NO: 3754 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPVTFGGGTKVEIK

SEQ ID NO: 3755 - protein, 126 aa, Homo sapiens
EVQLVESGGGLVKPGGSLRLSCAASGFPFITYSMNWVRQAPGKGLEWVSSISRNSDYIYYADSVRGRVTISRDNAENSLYLQMHSLRAEDTAVYYCARDVVRSGNYYIPRHGMDVWGRGTTVTVSS

SEQ ID NO: 3756 - protein, 110 aa, Homo sapiens
QSVLTQPPSASGTPGQRVTISCSGTSSNIGSNTVNWYQQLPETAPKLLIYGTDQRPSGVPDRFSGSKSGTSASLAISRLQSEDEADYYCATRDDSLSGPVFGGGTQLTVL

SEQ ID NO: 3757 - protein, 124 aa, Homo sapiens
QVQLVESGGGVVQPGRSLRLSCAASGFTFSNYAMHWVRQAPGKGLEWVAVISYDGSNKYYADSVKGRFTISRDNSKNTLYLQMNSLRAEDTAVYYCARDKLLWFGELLFDMDVWGKGTTVTVSS

SEQ ID NO: 3758 - protein, 107 aa, Homo sapiens
DIQMTQSPSSLSASVGDRVTITCRASQGISNYLAWFQQKPGKAPKSLIYDASSLQSGVPSKFSGSGSGTDFTLTISSLQPEDFATYYCQQYNSYPPSFGPGTKVDIK

SEQ ID NO: 3759 - protein, 120 aa, Homo sapiens
QLQLQESGPGLVKPSETLSLTCSVSGGSISSSNYYWGWIRQPPGKGLEWIGTVYYSGSTYHNPSLKSRVIISVDTSKKQFSLKLSSVTAADTAVYYCARLTWLRGLFDPWGQGTLVTVSS

SEQ ID NO: 3760 - protein, 110 aa, Homo sapiens
NFMLTQPHSVSESPGKTVTISCTHSSGSIASNYVQWYQQRPGSAPTTVIFEDNQRPSGVPDRFSGSIDSSSNSASLTISGLKTEDEADYYCQSYDSSNWVFGGGTKLTVL

SEQ ID NO: 3761 - protein, 126 aa, Homo sapiens
QVQLVQSETEVKKPGASVKVSCKASGYTFTSYGISWVRQAPGQGLEWMGWITAYNDKKNYAQKFQGRVTMTTDTSTSTAYMELRSLRSDDTAVYYCARDRNIGAVAGNYYYYMDVWGKGTTVTVSS

SEQ ID NO: 3762 - protein, 109 aa, Homo sapiens
NFMLTQPHSVSESPGKTVTISCTRSSGSIARNYVQWYQQRPGSAPTTVIYEDNHRPSGVPDRFSGSIDSSSNSASLTISGLKTEDEADYYCQSYDSSARFGGGTKLTVL

SEQ ID NO: 3763 - protein, 114 aa, Homo sapiens
EVQLVESGGGLVQPGGSLRLSCAASGFTVSSNYMSWVRQAPGKGLEWVSVIYSGGSTFYADSVKGRFTISRDNSKNTLYLQMKSLRPDDTAVYYCARDYRDWIWGQGTLVTVSS

SEQ ID NO: 3764 - protein, 107 aa, Homo sapiens
DIQLTQSPSSLSASVGDRVTITCQASQDISKYLNWYQQKPGKAPKLLIYDASNLETGVPSRFSGSGSGTDFTFTISSLQPEDIATYYCQQYDNLPRTFGQGTKVEIK

SEQ ID NO: 3765 - protein, 124 aa, Homo sapiens
QVQLVESGGGVVQPGRSLRLSCAASAFTFRSYAMHWVRQAPGKGLEWVAAISYDGSNKYYADSVKGRFTISRDNSKNTLYLQMNSLRAEDTAVYYCARDWAPTYYNMPSAFDIWGQGTVVTVSS

SEQ ID NO: 3766 - protein, 109 aa, Homo sapiens
SYVLTQPPSVSVAPGKTARITCGGNNIGSKSVYWYQQKPGQAPVLVVNDDSDRPSGIPERFSGSNSGNTATLTISRVEAGDEADYYCQVWDSSSDHPGVFGGGTKLTVL

SEQ ID NO: 3767 - protein, 120 aa, Homo sapiens
EVQLVESGGGLVQPGGSLRLSCAASGFTFSTYDMHWVRQTTGKGLEWVSAIGTAGDTYYPDSVKGRFTISRENAKNSLYLQMNSLRAGDTAVYYCARGGQWLRVWYFDLWGRGTLVTVSS

SEQ ID NO: 3768 - protein, 108 aa, Homo sapiens
DIQMTQSPSSLSASVGDRVTITCRASQSISRYLNWYQQKPGKAPKLLIYGASSLQSGVPSRFSGSGSGTDFTLTISSLQPEDFATYYCQQSYSNPELTFGGGTKVEIK

SEQ ID NO: 3769 - protein, 121 aa, Homo sapiens
DVQLVQSGAEVKKPGESLKISCKGSGYRFTSYWIAWVRQMPGKGLEWMGIIYPGDSDTRYSPSFQGQVTISADKSISTAYLQWSSLKASDTAMYYCASQAAAGYFYYMDVWGKGTTVTVSS

SEQ ID NO: 3770 - protein, 107 aa, Homo sapiens
DIQMTQSPSSLSASVGDRVTITCRASQSISMYLNWYQQKPGKAPKLLIYAASSLQSGVPSRFSGSGSGTDFTLTISSLQPEDFATYYCQQSYSTLWTFGQGTKVEIK

SEQ ID NO: 3771 - protein, 116 aa, Homo sapiens
EVQLLESGGGLVQPGGSLRLSCAASGFTFNSYAMSWVRQAPGKGLEWVSAISGSGGSTYYADSVKGRFSISRDNAKNTLFLQMNSLRAEDTAVYYCARSGGNFDYWGQGTLVTVSL

SEQ ID NO: 3772 - protein, 108 aa, Homo sapiens
SYELTQPPSVSVSPGQTARITCSGDVLAKRYVYWYQQKPGQAPVLVIYRDSERPSGIPERFSGSSSGTTVTLTISGVQAVDEADYYCQSADSSGTLYVFGTGTKVTVL

SEQ ID NO: 3773 - protein, 124 aa, Homo sapiens
EVQLAESGGGLVKPGGSLRLSCAASGFTFSNAWMNWVRQAPGKGLEWVGRIKSKTDGGATDYAAPVKGRFTISRDDSKNTLYLQMNSLKTEDTAVYYCTTDNWSYYGYWYFDFWGRGTLVTVSS

SEQ ID NO: 3774 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSPPLYTFGQGTKLEIK

SEQ ID NO: 3775 - protein, 122 aa, Homo sapiens
QLQLQESGPGLVKPSETLSLTCTVSGGSISSSSYYWSWIRQPPGKGLEWIGSIYYSGSTYYNPSLKSRVTISVDRSKNQFSLKLRSVTAADTAVYYCASPWYCSGGRCFDYWGQGTLVTVSS

SEQ ID NO: 3776 - protein, 108 aa, Homo sapiens
EIVLTQSPATLSLSPGERATLSCRASQSVSSYLAWYQQKPGQAPRLLMYDASNRATGIPARFSGSGSGTDFTLTISSLEPEDFAVYYCQQRSNWPPWTFGQGTKVEIK

SEQ ID NO: 3777 - protein, 123 aa, Homo sapiens
EVQLVESGGGLVQPGRSLRLSCAASGFTFDDYAMHWVRQAPGKGLEWVSGISWNSGSIGYADSVKGRFTISRDTAKNSLYLQMNSLRAEDTALYYCAKVGLTSCYFFCAFDIWGQGTMVTVSS

SEQ ID NO: 3778 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAVTNTLVFGGGTKLTVL

SEQ ID NO: 3779 - protein, 121 aa, Homo sapiens
EVQLVESGGGLVQPGGSLRLSCAASGFRFSSYEMNWVRQAPGKGLEWVSYISRTGSSIFYADSVKGRFTISRDDAKNSLYLQMNSLRAEDTAVYYCARAMYYYGSGTLDYWGQGTLVTVSS

SEQ ID NO: 3780 - protein, 107 aa, Homo sapiens
DIQMTQSPSSLSASVGDRVTITCRASQSISNFLNWYQQKPGKAPKLLIYDVSSLQSGVPSRFSGSGSGTDFALTISSLQPEDFATYYCQQSYTSPPSFGPGTEVDSK

SEQ ID NO: 3781 - protein, 127 aa, Homo sapiens
QVQLVESGGGVVQPGRSLRLSCAASGFTISSYGMHWVRQAPGKGLEWVAVISYDGSDKYYADSVKGRFTISRDNSENTLYLQMNSLRAEDTAVYYCAKAYRGDMITFGGVIAPLEYWGQGTLVTVSS

SEQ ID NO: 3782 - protein, 111 aa, Homo sapiens
QSVLTQPPSVSGAPGQRVTISCTGSSSNIGAGYDVYWYQQLPGTAPKLLIYGNTNRPSGVPDRFSGSKSGTSASLAITGLQAEDEADYYCQSYDSSLSVLVFGTGTKVTVL

SEQ ID NO: 3783 - protein, 130 aa, Homo sapiens
QVQLQESGPGLVKPSQTLSLTCTVSGGSISSGIYYWSWIRQPAGKGLEWIGRIYSSGSTNYNPSLKSRVSMSVDTSKNQFSLKLRSVSAADTAVYYCARDCPHYNFWSGHYKDYYYMDVWGKGTTVTVSS

SEQ ID NO: 3784 - protein, 112 aa, Homo sapiens; identical to SEQ ID NO: 662

SEQ ID NO: 3785 - protein, 121 aa, Homo sapiens
QVQLVQSGAEVKKPGASVKVSCKISGYTLTEVSIHWVRQAPGKGLEWMGGFDPEAGETIYARKFQGRVTMTEDTSTDTAYMDLSGLRSEDTAVYYCATSPAIYRQTWFDPWGQGTLVTVSS

SEQ ID NO: 3786 - protein, 111 aa, Homo sapiens
QSVLTQPPSVSAAPGQNVTISCSGSSSNIGNNYVSWYQQLPGTAPKLLIYDNNKRPSGIPDRFSGSKSGTSATLGISGLQTGDEADYYCGTWDTSLSVGGVFGGGTKLTVL

SEQ ID NO: 3787 - protein, 124 aa, Homo sapiens
QVQLVQSGAEVKKPGSSVKVSCKASGGTFSSYTISWVRQAPGQGLEWMGSIIPILGIANYAQKFPGRVTITADKSTSTAYMELSSLRSEDTAVYFCANQRGYSGYGAVSWFDPWGQGTLVTVSS

SEQ ID NO: 3788 - protein, 111 aa, Homo sapiens; identical to SEQ ID NO: 1096

SEQ ID NO: 3789 - protein, 126 aa, Homo sapiens
QVQLVQSESELKKPGASVKVSCKASGYTFTTYAMNWVRQAPGQGLEWMGWINTNTGNPTYAQGFTGRFVFSLETSVSTAYLQINSLKAEDTAVYYCARDFDDNWNGDYSYYYMDVWGKGTTVTVSS

SEQ ID NO: 3790 - protein, 112 aa, Homo sapiens
DIVMTQTPLSLSVTPGQSASISCKSSQSLLHSDGKTYLSWYLQKPGQSPQLLIYEFYNRFSGVPDRFSGSGSGTDFTLKISRVEAEDVGVYYCMQSIELPYTFGQGTKLEIK

SEQ ID NO: 3791 - protein, 123 aa, Homo sapiens
QVQLQQLGAGLLKPSETLSLTCTVSGASFAGYYWRWIRQSPGKGLEWLGEINQSGVTDYNPSLKSRVTISVDTSKTQLSLRLTSVTAADTAVYYCARRGYFYGSEIPYYFDYWGQGSLVTVSS

SEQ ID NO: 3792 - protein, 108 aa, Homo sapiens
EIVLTQSPGTLSLSPGERATLSCRASESVSGNSLAWYQQKPGQAPSLLIYGASSRATGIPDRFSGRGSGTDFSLTISRLEPEDFAVYYCQQYGSSPRTFGQGTKVEIK

SEQ ID NO: 3793 - protein, 123 aa, Homo sapiens
QVQLVESGGGVVQPGRSLRLSCAASGFTFSSYGIHWVRQAPGKGLEWVALISYDGSDKFYADSVKGRFTISRDNSKNTLYLVMNSLRVDDTAVYYCAKGVGLYSSPLYYFDYWGQGTLVTVSS

SEQ ID NO: 3794 - protein, 106 aa, Homo sapiens
DIQMTQSPSSLSASVGDRVTITCQASQDINNYLNWYQQKPGKAPELLIYDASNLEAGVPSRFSGSGSGTDFTFTISSLQPEDIATYYCQQFDNLPSFGPGTKVDIK

SEQ ID NO: 3795 - protein, 128 aa, Homo sapiens
EVQLVQSGAEVKKPGESLKISCKGSAYSFTSYWIAWVRQMPGKGLEWMGIIYPGDSDTRYSPSFQGQVTISADKSISTAYLQWSSLKASDTAMYYCTRGRPVSGIWVGETAPYYFDYWGQGTLVTVSS

SEQ ID NO: 3796 - protein, 107 aa, Homo sapiens
EIVLTQSPGTLSLSPGERPTLSCRASQSVSSNYLAWYQQKPGQAPRLLIYGASSRASGIPDRFSGSGSGTDFTLTISRLEPEDFAVYYCQQYGSSPTFGQGTRVEIK

SEQ ID NO: 3797 - protein, 122 aa, Homo sapiens
QVQLVESGGGVVQPGRSLRLSCAASGFTFSSYAMHWVRQAPGKGLEWVAVISYDGSDKYYADSVKGRFTISRDNSKNTLYLQMNSLRGEDTAVYYCAKGDWYSSSWYPLEYWGQGILVTVSS

SEQ ID NO: 3798 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQHYNDWPYTFGQGTKLEIK

SEQ ID NO: 3799 - protein, 124 aa, Homo sapiens
QVQLVESGGGVVQPGRSLRLSCAASGFTFSSYAMHWVRQAPGKGLEWVAVISYDGSNKYFADSVRGRFTISRDNSKNTLYLQMNSLRAEDTAVYYCARPVVPAVMGSYYGMDVWGQGTTVTVSS

SEQ ID NO: 3800 - protein, 110 aa, Homo sapiens
QSVLTQPPSASGTPGQRVTISCSGSSSNIGSNTVNWYQHLPGTAPKLLIYSNNQRPSGVPDRFSGSKSGTSASLAISGLQSEDEADYYCAAWDDSLNGVVFGGGTKLTVL

SEQ ID NO: 3801 - protein, 117 aa, Homo sapiens
EVQLVESGGGLIQPGGSLRLSCAASEFIVSSNYMSWVRQAPGKGLEWVSVIYPGGSTFYADSVKGRFTISRDSSKNTLYLQMNSLRAEDTAVYYCARDYGDFYFDYWGQGTLVTVSS

SEQ ID NO: 3802 - protein, 107 aa, Homo sapiens
EIVMTQSPATLSVSPGERATLSCRASQSVSSNLAWYHQKPGQAPRLLIYGASTRATGIPARFSGSGSGTEFTLTISSLQSEDFAVYSCQQYNNWPRTFGQGTKVEIK

SEQ ID NO: 3803 - protein, 128 aa, Homo sapiens
QVQLQESGPGLVKPSQTLSLTCSVSGASISSGSYYWSWIRQPAGKGLEWVGRLYTRGSTNYNPSLKSRVTMSVDTSKNQFSLKLSSVTAADTAVYYCAVSTYYYGSGSLYYYKYMDVWGKGTTVTVSS

SEQ ID NO: 3804 - protein, 110 aa, Homo sapiens
QSVLTQPPSASGTPGQRVTISCSGSSSNIGSNIVNWYQHLPGTAPKLLIYSNNQRPSGVPDRFSGSKSGTSASLAISGLQSEDEADYYCAAWDDSLNGYVFGTGTKVTVL

SEQ ID NO: 3805 - protein, 121 aa, Homo sapiens
QVQLVQSGAEVKKPGSSVKVSCKASGGTFGSYTINWVRQAPGQGLEWMGRIFPILSIATYAQKFLGRVAITADKSTSTAYMELSSLRSEDTAVYYCARGVVASTPNWFDPWGQGTLVTVSS

SEQ ID NO: 3806 - protein, 106 aa, Homo sapiens
EIVMTQSPATLSVSPGERATLSCRASQSVSSNLAWYQQKPGQAPRLLIYDASTRATGIPARFSGSGSGTEFTLTISSLQSEDFAVYYCQQYNNWLTFGGGTKVEIK

SEQ ID NO: 3807 - protein, 122 aa, Homo sapiens
EVQLVESGGGLVQPGGSLRLSCAASGFTFSSYDMHWVRQATGKGLEWVSVIGTAGDTYYPDSVKGRFTISRENAKNSLYLQMNSLRAGDTAVYYCARAIYDSSGYYFAFDMWGQGTMVTVSS

SEQ ID NO: 3808 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTLALTFGGGTKVEIK

SEQ ID NO: 3809 - protein, 121 aa, Homo sapiens
EVQLVESGGGLVQPGGSLRLSCAASGFRFSNYEMNWVRQAPGKGLEWVSYISSTGGSIFYADSVKGRFTISRGDAKNSVYLQMNSLRAEDTAVYYCARAMYYYGSGTLDYWGQGTLVTVSS

SEQ ID NO: 3810 - protein, 107 aa, Homo sapiens
DIQMTQSPSSLSASVGDRVTITCRASQSISRFLNWYQQKPGTAPKLLIYDVSSLQSGVPTRFSGSGSGTDFTLTISSLQPEDFATYYCQQSYTTPPAFGPGTRVDIK

SEQ ID NO: 3811 - protein, 123 aa, Homo sapiens
QVQLVESGGGVVQPGRSLRLSCAASGFTFSTYAMHWVRQAPGKGLEWVAVISYDGSNKYYSDSVKGRFTISRDNSKNTLYLQMNSLRAEDTAVYYCARAHTSGWPLGDYFDYWGQGTLVTVSS

SEQ ID NO: 3812 - protein, 112 aa, Homo sapiens
DIVMTQSPLSLPVTPGEPASISCKSSQSLLHSNGYNYLDWYLQKPGQSPQLLIYLGSNRASGVPDRFSGSGSGTDFTLKISRVEAEDVGVYYCMQALRTPLTFGGGTKVEIK

SEQ ID NO: 3813 - protein, 123 aa, Homo sapiens
QVQLVESGGGVVQPGRSLRLSCAASGFTFSSYGMHWVRQAPGKGLEWVAVISFDGSNKYYVDSVKGRFTISRDNSKNTQYLQMNSLRAEDTAVYYCAKEGFGYGSAKYYFDYWGQGTLVTVSS

SEQ ID NO: 3814 - protein, 107 aa, Homo sapiens; identical to SEQ ID NO: 666

SEQ ID NO: 3815 - protein, 117 aa, Homo sapiens
EVQLVESGGGLIQPGGSLRLSCAASGFTVSSNYMSWVRQAPGKGLEWVSLIYSGGSTFYADSVKGRFTISRDNSKNTLYLQMNSLRAEDRAVYYCARDLQSYGMDVWGQGTTVTVSS

SEQ ID NO: 3816 - protein, 109 aa, Homo sapiens
DIQLTQSPSFLSASVGDRVTITCRASQGISNYLAWYQQKPGKAPKLLIYAASTLQSGVPSRFSGSGSGTEFTLTISSLQPEDFATYYCQQLNSYPSMYTFGQGTKLEIK

SEQ ID NO: 3817 - protein, 129 aa, Homo sapiens
QVQLVESGGGVVQPGRSLRLSCAASGFTFSTSGMHWVRQAPGKGLEWVAIISYDGSNKHYAVSVKGRFTISRDNSKNTLYLQMNSLRAEDTAVYYCAKGGPNKVVLSFGDLLDYGLDVWGQGATVTVSS

SEQ ID NO: 3818 - protein, 112 aa, Homo sapiens
DIVMTQTPLSLSVTPGQPASISCKSSQSLLHSDGKTYLYWYLQKPGQSPQLLIYEVSTRFSGVPDTFSGSGSGTDFTLKISRVEAEDVGVYYCMQSIQLPYTFGQGTKLEIK

SEQ ID NO: 3819 - protein, 120 aa, Homo sapiens
QVQLQESGPGLVKPSQTLSLTCTVSGGSISSGNYYWSWIRQPPGKGLEWIGHIYYSGTTHYNPSLKSRVSISVDTSKDQISLKLTSVTAADTAVYYCARLLWLRGAFDIWGQGTMVTASS

SEQ ID NO: 3820 - protein, 111 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSFDSNNPVVFGGGTKLTVL

SEQ ID NO: 3821 - protein, 126 aa, Homo sapiens
QVQLVQSGSELKKPGASVKVSCKASGYTFTTYAMNWVRQAPGQGLEWMGWINTNTGEPTYAQGFTGRFVFSLDTSVSTAYLQISSLKAEDTAVYYCARDHDRNFQLEYNYYYMDVWGKGTTVTVSS

SEQ ID NO: 3822 - protein, 112 aa, Homo sapiens
DIVMTQTPLSLSVTPGQPASISCKSGESLLHGDGKTYLYWYLQKPGQSPQLLIYEVFNRFSGVPDRFSGSGSGTDFTLKISRVEAEDVGVYYCMQSIQLPLTFGGGTKVEIK

SEQ ID NO: 3823 - protein, 126 aa, Homo sapiens
QVQLVESGGGVVQPGRSLRLACAASGFTFSSYGMHWVRQAPGKGLEWVAVISYDGNNKYYADSLKGRFTISRDDSKNTLYLQMNSLRAEDTAVYYCAKDRTAVFLFFGLGDAFDIWGQGTMVTVSS

SEQ ID NO: 3824 - protein, 108 aa, Homo sapiens
SYVLTQPPSVSVAPGKTARITCGGNNIGSKSVHWYQQKPGQAPVVVVYDDSDRPSGLPERFSGSNSGNTATLTISRVEAGDEADYYCQVWDSSSDHWVFGGGTKLTVL

SEQ ID NO: 3825 - protein, 117 aa, Homo sapiens
QVQLVQSGSELKKPGASVKVSCKASGYTFSSYSMNWVRQAPGQGLEWMGWINTNTGNPTFAQGFTGRFVFSLDTSVSTAYLQISSLKAEDTAVYYCARELGTSVDLWGQGTLVTVSS

SEQ ID NO: 3826 - protein, 108 aa, Homo sapiens
SSELTQDPAVSVALGQTVRITCQGDSLRSYYASWYQQKPGQAPVLVIYGKNNRPSGIPDRFSGSSSGNTASLTITGAQAEDEADYYCNSRDSSGYHPVFGGGTKLTVL

SEQ ID NO: 3827 - protein, 127 aa, Homo sapiens
QVQLVESGGGVVQPGRSLRLSCVASEFTFSNHGMHWVRQAPGKGLEWVAVISYDGSDKYYAHSVKGRFTISRDSSKNTLYLQMNSLRAEDTAVYYCAKAYRGDMITFGGVIAPLDYWGQGTLVTVSS

SEQ ID NO: 3828 - protein, 111 aa, Homo sapiens
QSVLTQPPSVSGAPGQRVTISCTGSSSNIGAGYDVYWYQQFPGSAPKLLIYGYNNRPSGVPDRFSGSKSGTSASLAITGLQAEDEADYYCQSYDSSLSVLVFGTGTKVTVL

SEQ ID NO: 3829 - protein, 130 aa, Homo sapiens
EVQLVESGGGLVQPGRSLRLSCAASGFTFDDYAMHWVRQAPGKGLEWVSGISWNSGTLGYADSVKGRFTFSRDNAKNSVYLQMNSLRAEDTALYYCAKDGPVADTSRRAHTYYFYGMDVWGQGTTVTVSS

SEQ ID NO: 3830 - protein, 108 aa, Homo sapiens
SYVLTQPPSVSVAPGKTARITCGGNNIGSKSVNWYQQKPGQAPVLVVYDDSDRPSGIPERFSGSNSGNTATLTISRVEAGDEADYYCQVWDTSTDLVVFGGGTKLTVL

SEQ ID NO: 3831 - protein, 122 aa, Homo sapiens
QVQLVQSGAEVKKPGASVKVSCKVSGYTLIELSMHWVRQAPGKGLEWLGGFDPEDAETIYAQKFQGRVTMTEDTSTDTAYMELSSLRSEDTAVYYCATVPAAITGPTFVWYWGQGTLVTVSS

SEQ ID NO: 3832 - protein, 110 aa, Homo sapiens
QSVLTQPPSASGTPGQRVTISCSGSSSNIGSNTVNWYQQLPGTAPKLLIYTHNQRPSGVPDRFSGSKSGTSASLAISGLQSEDEADYYCAAWDDSLNGWVFGGGTKLTVL

SEQ ID NO: 3833 - protein, 128 aa, Homo sapiens
QVQLVQSGAEVKKPGSSVKVSCKASGGTFSSNTISWVRQAPGQGLEWMGRIIPLLGTVNYAQKFQGRVTITADKSTTTAYMELSSLRSEDTAVYYCARDAGGITIFGVEHYYYYMDVWGKGTTVTVTS

SEQ ID NO: 3834 - protein, 110 aa, Homo sapiens
EIVLTQSPGTLSLSPGERATLSCRASQSVSSSHLAWYQQKPGQAPRLLIYDASSRATGIPDRFSGSGSGTDFTLTISRLEPEDFAVYYCQQYGSSPPMYTFGQGTKLEIK

SEQ ID NO: 3835 - protein, 125 aa, Homo sapiens
EVQLLESGGGLVQPGGSLRLSCAASGFTFSSYAMNWVRQAPGKGLEWVSTISGSGGSTYYADSVKGRFTISRDNSKNTLYLQMNSLRADDTAVYYCAKGPMAYILVVVAAYFDYWGQGTLVTVSS

SEQ ID NO: 3836 - protein, 110 aa, Homo sapiens
QSVLTQPPSVSAAPGQKVTISCSGSSSNIGNNYVSWYQQLPGIVPKLLIYDNNKRLSGIPDRFSGSKSGTSATLGITGLQTGDEADYYCGTWDSSLSAVVFGGGTKLTVL

SEQ ID NO: 3837 - protein, 121 aa, Homo sapiens
QVQLVQSGAEVKKPGSSVKVSCKASGGTFSDYVIYWVRQAPGQGLEWMGGTTPIFGTANYAQKFQGRVTITADESTSTAYMELSSLRSEDTAVYYCARSCGDCYSADFDSWGQGTQVTVSS

SEQ ID NO: 3838 - protein, 108 aa, Homo sapiens
EIVLTQSPATLSLSPGERATLSCRASQSISSFLAWYQQKPGQAPRLLIYDASNRATGIPARFSGSGSGTDFTLTISSLEPEDFAVYYCQRRSNWPPFTFGPGTKVDIK

SEQ ID NO: 3839 - protein, 121 aa, Homo sapiens
QVQLVQSGAEVKKPGASVKVSCKVSGYTLIELSMHWVRQAPGKGLEWMGGFNPEDVETIYAQKFQGRVTMTEDTSTDTAYMELSSLRSEDTAVYYCATAFSIFGVVMFDYWGQGTLVTVST

SEQ ID NO: 3840 - protein, 109 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNALFGGGTKLTVL

SEQ ID NO: 3841 - protein, 124 aa, Homo sapiens
EVQLLESGGGLVQPGGSLRLSCAASGFTFSSYAMSWVRQAPGKGLEWVSTISGGGGSTYYADSVKGRFTISRDNSKNTLYLQMNSLRAEDTAVYYCAKDEMGVIVVVITLFDYWGQGTLVTVSS

SEQ ID NO: 3842 - protein, 110 aa, Homo sapiens
QSVVTQPPSVSAAPGQKVTISCSGSSSNIGKNYVSWYQQLPGTVPKLLIYDNNKRPSGIPDRFSGSKSGTSATLGITGLQTGDEADYYCGTWDSSLSVFVFGTGTKVTVL

SEQ ID NO: 3843 - protein, 123 aa, Homo sapiens
EVQLVESGGGLVQPGRSLRLSCAASGLTFEDYAMHWVRQVPGKGLEWVSGISWNSGTIGYADSVKGRFIISRDNAKNSLYLQMRSLRAEDTALYYCAKDVGFGELLYYAFDIWGQGTMVTVSS

SEQ ID NO: 3844 - protein, 110 aa, Homo sapiens; identical to SEQ ID NO: 762

SEQ ID NO: 3845 - protein, 127 aa, Homo sapiens
QVQLVESGGGVVQPGRSLRLSCAASGFTFSNYGMHWVRQAPGKGLEWVAVISYDGSNKYYADSVKGRFTISRDNSQNTLYLQMNSLRAEDTAVYYCAKQGEPYCSAGNCYSGYFDYWGQGTLVTVSS

SEQ ID NO: 3846 - protein, 108 aa, Homo sapiens
SYELTQPPSVSVSPGQTARITCSADALPKQYAYWYQQKPGQAPVLVIYKDSERPSGIPERFSGSSSGTTVTLTISGVQAEDEADYYCQSGDSSGTPVVFGGGTKLTVL

SEQ ID NO: 3847 - protein, 123 aa, Homo sapiens
QVQLVESGGGVVQPGRSLRLSCAASGFTFSSYGMHWVRQAPGKGLEWGALISFDGENKFYADSVKGRFTISRDNSKNTLYLQMNSLRAEDTAVYYCAKEGFGYASAKYYFDYWGQGTLVTVSS

SEQ ID NO: 3848 - protein, 107 aa, Homo sapiens
DIQMTQSPSSLSASVGDRVTITCQASQDISNYLNWYQQKPGKAPKLLIYDASNLETGVPSRFSGSGSGTDFTFTISSLQPEDFATYFCQEYDDLPLTFGGGTKVEIK

SEQ ID NO: 3849 - protein, 118 aa, Homo sapiens
QVQLQQWDAGLLKPSETLSLTCAVYGGSFSGYYWTWIRQPPGKGLEWIGEIYPSGSTNYNPSLKSRVTISLDTSNNQFSLKVTSVTAADTAVYYCARRPWLRGTFDYWGQGTLVTVSS

SEQ ID NO: 3850 - protein, 107 aa, Homo sapiens
EVVLTQSPATLSLSPGERASLSCRASQSVRSSLAWYQQKPGQPPRLLIYGASNRATGIPARFSGSGSGTDFTLTVSSLEPEDFVVYYCQQRTNWPGTFGQGTRLEIK

SEQ ID NO: 3851 - protein, 123 aa, Homo sapiens
QVQLVQSGAEVKKPGASVKVSCKASGYTFSSYEINWVRQATGQGLEWMGRMTLNSGNTGYAQNFQGRVTMTRDTSISTAYMELSGLRSEDTAVYYCARMRSGWPTHGRPDDYWGQGTLVTVSS

SEQ ID NO: 3852 - protein, 110 aa, Homo sapiens
QSVLTQPPSASGTPGQRVTISCSGSNSNIGSYTVNWYQQLPGTAPKLLIYGNNQRPSGVPDRFSGSKSGTSASLAISGLQSEDEADYYCLAWDDSRNGLVFGGGTKLTVL

SEQ ID NO: 3853 - protein, 114 aa, Homo sapiens
EVRLVESGGGLVQPGGSLRLSCAASGFTVSSNYMSWVRQAPGKGLEWVSLIYSGGSTFYADSVKGRFTISRDNSKNTLYLQMNSLRAEDTALYYCARDTRDEAWGQGTLVTVSS

SEQ ID NO: 3854 - protein, 107 aa, Homo sapiens
DIQMTQSPSSLSASVGDRVTITCQASQDISNYLNWYQQKPGKAPKVLIYDASNLETGVPSRFSGSGSGTDFTFTISSLQPEDIATYYCQQYDNLPRTFGQGTKLEIK

SEQ ID NO: 3855 - protein, 127 aa, Homo sapiens
QVQLVQSGAEVKKPGASVKVSCKASGYTFTSYGISWVRQAPGQGLEWMGWISGYNGHTSYAQKLQGRVAMTTDTSTSTAYMELRSLRSDDTAVYYCARDQGSDYYDSSDYYAALDYWGQGTLVTVSS

SEQ ID NO: 3856 - protein, 107 aa, Homo sapiens
SYELTQPSSVSVSPGQTARITCSGDVLAKKYARWFQQKPGQAPILVIYKDSERPSGIPERFSGSSSGTTVTLTISGAQVEDEADYYCYSAADNNPRVFGGGTKLTVL

SEQ ID NO: 3857 - protein, 122 aa, Homo sapiens
QVQLQESGPGLVKPSETLSLTCTVSGGSITNSYWTWIRQPPGKGLEWIGYIYYSGSTNYNPSLKSRVTILVDTSKKQFSLRLSSVTAADTAIYYCARGEHQLLYWDNWFDPWGQGTLVTVSS

SEQ ID NO: 3858 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVL

SEQ ID NO: 3859 - protein, 130 aa, Homo sapiens
QVTLRESGPALVKPTQTLTLTCTFSGFSLSTSGMCVSWIRQPPGKAVEWLALIGWDDDKYYSTSLRTRLAISKDTSKNQVVLTMTNVDPVDTATYYCARTRPTGHSGYDFGFPEAFFDLWGQGTLVTVSS

SEQ ID NO: 3860 - protein, 102 aa, Homo sapiens
DIQMTQSPSSLSASVGDRVTITCRASQSISSYLNCYQQKSGKAPKLLIYAASSLQSGVPSRFSGSGSGTDFTLTISSLQPEDFATYNCLHITFGPGTKVDIK

SEQ ID NO: 3861 - protein, 122 aa, Homo sapiens
QVQLVQSGAEVKKPGASVKVSCKVSGYTLTELSMHWVRQALGKGLEWMGGFDPEDVETIYAQKFQGRVTMTEDTSTDTAYMELSSLRSEDTAVYYCATVPAAITGTTFVWYWGQGTLVTVSS

SEQ ID NO: 3862 - protein, 110 aa, Homo sapiens
QSVLTQPPSASGTPGQRVTISCSGSSSNIGSSTVNWYQQLPGTAPKLLIYSNNQRPAGVPDRFSGSKSGTSASLAISGLQSEDGADYYCAAWDDSLNGWVFGGGTKLTVL

SEQ ID NO: 3863 - protein, 123 aa, Homo sapiens
QVQLVESGGGVVQPGRSLRLSCAASGFTFSNYDMHWVRQAPGKGLEWVAVISYDGSNKYYADSVRGRFTISRDNSKSTLYLQINSLRAEDTAVFYCAKSGYSYAYRHYYFDYWGQGTLVTVSS

SEQ ID NO: 3864 - protein, 109 aa, Homo sapiens
SYVLTQPPSVSVAPGKTARITCGGNNIGSKSVHWYQQKPGQAPVLVVCDDSDRPSGIPERFSGSNSGNTATLTISRVEDGDEADYYCQVWDSSSDHPVVFGGGTKLTVL

SEQ ID NO: 3865 - protein, 124 aa, Homo sapiens
EVQLVESGGGLVQPGGSLRLSCAASGFTFSSYDMHWVRQATGKGLEWVSAIGTAGDTYYPDSVKGRFTISRENAKNSLFLQMNSLRGGDTAVYYCARGDSISWYGAFYYYMDVWGKGTTVTVSS

SEQ ID NO: 3866 - protein, 108 aa, Homo sapiens
DIQMTQSPSSLSASVGDRVTITCRASQSISRYLNWYQQRPGKAPKLLIYAASSLQSGVPSSFSGSGSGTDFTLTISSLQPEDFATYYCQQSYSSPPWTFGQGTKVEIK

SEQ ID NO: 3867 - protein, 117 aa, Homo sapiens
EVQLVESGGGLIQPGGSLRLSCAASGVIVSSNYMSWVRQGTGKGLEWVSLIYSGGSTYYADSVKGRFTISRDNSKNTLYLQMNNLRAEDTAVYYCARDLQVYGMDVWGQGTTVTVSS

SEQ ID NO: 3868 - protein, 108 aa, Homo sapiens
SYVLTQPPSVSVAPGKTARITCGGNNIGSESVHWYQQKPGQAPVLVVYDDSDRPSGIPERFSGSDSGNTATLTISRVEAGDEADYYCQVWDSSSDHWVFGGGTKLTVL

SEQ ID NO: 3869 - protein, 127 aa, Homo sapiens
QVQLVESGGGVVQPGRSLRLSCAASGFTLSSHGMHWVRQAPGKGLEWVAVISYDGNDKYYADSVKGRFTISRDNSKNTLYLQMNSLRAEDTAVYYCAKAYRGDMITFGGVIAPLDYWGQGTLVTVSS

SEQ ID NO: 3870 - protein, 111 aa, Homo sapiens
QSVLTQPPSVSGAPGQSVTISCTGSSSNIGAGYDVYWYQQLPGTAPKLLIYGNNNRPSGVPDRFSGSKSGTSASLAITGLQAEDEANYYCQSYDSSLTVLVFGTGTKVTVL

SEQ ID NO: 3871 - protein, 127 aa, Homo sapiens
QVQLVQSGAEVKKPGASVKVSCKASGYTFASYDINWVRQATGQGPEWMGWMIPNIGNTGYAQKFQGRVTMTRNTSISTAYMELSSLTSEDTAVYYCARVSRLFNDFGLRHEAPVDFWGQGTRVTVSS

SEQ ID NO: 3872 - protein, 110 aa, Homo sapiens
QSVLTQPPSVSGAPGQRVTISCTGSSSNIGAGYDVHWYQQLPGTAPKLLIYGYSSRPSGVPDRFSGSKSGTSASLAITGLQAEDEADYYCQSYDSSLSVLFGGGTKLTVL

SEQ ID NO: 3873 - protein, 121 aa, Homo sapiens
EVQLVESGGGLVQPGGSLRLSCAASGFSFSSYEMNWVRQAPGKGLEWVSYISSTGSSIFYADSVKGRFTISRDDAKNSVYLQMNSLRAEDTAVYYCARAMYYYGSGTLDYWGQGTLVTVSS

SEQ ID NO: 3874 - protein, 107 aa, Homo sapiens
DIQMTQSPSSLSASVGDRVTITCRASQSISSYLNWYQQKPGKAPKLLIYDVSSLQSGVPSRFSGSGSGTDFTLTISSLQPEDFATYYCQQSYTTPPAFGPGTKVDIK

SEQ ID NO: 3875 - protein, 119 aa, Homo sapiens
EVQLVESGGGLVKPGGSLRLSCAASGFTFSSYSMNWVRQAPGKGLEWVSTISDSSSYIYYADSVKGRFTISRDNAKNSLYLQLNSLRAEDTAVYYCAREGQWERLFVSWGQGTLVTVSS

SEQ ID NO: 3876 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYLGTFGQGTKVEIK

SEQ ID NO: 3877 - protein, 124 aa, Homo sapiens
EVQLVESGGGLVQPGGSLRLSCAASGFTFSSYEMNWVRQAPGKGLEWVSYISSSGSSIYYADSVKGRFTISRDNAKNSLYLQMNSLRAEDTAVYYCAREPLGPGYYNYYYMDVWGKGTTVTVSS

SEQ ID NO: 3878 - protein, 112 aa, Homo sapiens
QSALTQPASVSGSPGQSITISCTGTSSDVGSYNLVSWYQQHPGKAPQLMIYEVSKRPSGVSNRFSGSKSGNTASLTISGLQAEDEADYYCCSYAGSSTFPYVFGTGTKVTVL

SEQ ID NO: 3879 - protein, 115 aa, Homo sapiens
EVQLVESGGGLVQPGGSLRLSCAASGFTFSNYWMSWVRQAPGKGLEWVANIKEDGSEKYYVDSVKGRFTISRDNAKKSVYLQMNSLRVEDTAVYYCARGHGFDPWGQGTLVTVSS

SEQ ID NO: 3880 - protein, 108 aa, Homo sapiens
SSELTQDPAVSVALGQTVRITCQGDSLRSYSASWFQQKPGQAPILVIYPKNNRPSGIPDRFSGSSSGNRASLTITGAQAEDEADYYCNSRDSSGNHYVFGTGTKVTVL

SEQ ID NO: 3881 - protein, 121 aa, Homo sapiens
QVQLVQSGAEVKKPGSSVKVSCKASGGTFSSYAISWVRQAPGQGLEWMGGIIPIFGTAKYAQKFQGRVTITADESTSTVYMELSSLRSEDAAVYYCARTSGYDAYVVSDYWGQGTLVTVSS

SEQ ID NO: 3882 - protein, 109 aa, Homo sapiens
EIVLTQSPATLSLSPGERATLSCRASQSVSSFLAWFQQKPGQAPRLLIYDASNRATGIPARFTGSGSGTDFTLTISSLEPEDFAVYYCQQRSNWPPLLTFGGGTKVEIK

SEQ ID NO: 3883 - protein, 121 aa, Homo sapiens
QVQLVESGGGVVQPGRSLRLSCAASGFIFSSYAIHWVRQAPGKGLEWVAVISYDGSSEYYADSVKGRFTISRDNSKNTLYLQMNRLRPEDTAVYYCARAYSGTYYSPFDYWGQGTLVTVSS

SEQ ID NO: 3884 - protein, 108 aa, Homo sapiens
EIVMTQSPATLSVSPGERATLSCRASQSVSSNLAWYQQKPGQGPRLLIYGASTRATGIPARFSGSGSGTEFTLTISSLQSEDFAVYYCQQYNKWPPNTFGQGTKLEIK

SEQ ID NO: 3885 - protein, 121 aa, Homo sapiens
EVQLVESGGVVVQPGGSLRLSCAASGFTFDDYTMHWVRQAPGKGLEWVSLISWDGGSTYYADSVEGRFTISRDNSKNSLYLQMNSLRTEDTALYYCAKDLDPVVMFPVSSWGQGTRVTVSS

SEQ ID NO: 3886 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYYSYSAAFGQGTKVEIK

SEQ ID NO: 3887 - protein, 123 aa, Homo sapiens
QVQLVQSGAEVKKPGSSVKVSCKASGGTFSSYVDIWVRQAPGQGLEWMGGIIPIFNTTNYAQKFQGRVTITADESTSTAYMELSSLRSEDTAVYYCARLQITMVRGVITDDYWGQGTLVTVSS

SEQ ID NO: 3888 - protein, 109 aa, Homo sapiens
EIVLTQSPATLSLSPGERATLSCRASQSVSSYLAWYQQKPGQAPRLLIYDASNRATGIPARFSGSGSGTDFTLTISGLEPEDFAVYYCHHRSNWPPRLTFGGGTKVEIK

SEQ ID NO: 3889 - protein, 122 aa, Homo sapiens
QVQLVQSGAEVKKPGSSVKVSCKASGGTFSSYAISWVRQAPGQGLEWMGGIIPIFGTAIYAQKFQGRVTITAGESTSTGYMELSSLRSEDTAVYYCARTMGYDSSGYYEDYWGQGTLVTVSS

SEQ ID NO: 3890 - protein, 109 aa, Homo sapiens
EIVLTQSPATLSLSPGERATLSCRASQSISNFLAWYQQKPGQAPRLLIYDASNRATGIPARFSGSGSGTDFTLTISSLEPGDFAVYYCQQRSNWPPRLTFGQGTRLEIK

SEQ ID NO: 3891 - protein, 130 aa, Homo sapiens; identical to SEQ ID NO: 3859

SEQ ID NO: 3892 - protein, 107 aa, Homo sapiens
EIVMTQSPATLSVSPGERATLFCRASQSVSSNLAWYQQKSGQAPRLLIYGASTRATGIPARFSGSGSGTEFTLTISSLQSEDFAVYYCQQYNNWPLTFGQGTKVEIK

SEQ ID NO: 3893 - protein, 121 aa, Homo sapiens
QVQLVESGGGVVQPGRSLRLSCAASGFTFSSYAMHWVRQAPGKGLEWVAVISYDGINKYYADSVKGRFTISRDNSKNTLYLQMNSLRAEDTAVYYCARGKSGSYYYGMDVWGQGTTVTVSS

SEQ ID NO: 3894 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYLWTFGQGTKVEIK

SEQ ID NO: 3895 - protein, 126 aa, Homo sapiens
EVQLVESGGGFVQPGRSLRLSCAASGFTFDDHVMHWVRQAPGKGLEWVSGISWNSGNIDYADSVKGRFTISRDNAKNSLYLQMNSLRAEDTALYYCAKDSQYCSSTNCYFSWFAPWGQGTLVTVSS

SEQ ID NO: 3896 - protein, 107 aa, Homo sapiens
DIQMTQSPSSLSTSVGDRVTITCRASQSIDSYLNWYQQTPGKAPKLLIYAASNLQSGVPSRFSGSGSGTDFTLTISNLQPEDFATYYCQQSYSPPRTFGQGTKLEIK

SEQ ID NO: 3897 - protein, 128 aa, Homo sapiens
QVQLQESGPGLVKPSETLSLTCTVSGCSISSYYWSWIRQPPGKGLEWIGYISYSGSTNYNPSLKSRVTISVDTSKNQFSLKLSSVTAADTAVYYCARISDYYGSGTSYFGYYYGMDVWGQGTTVTVSS

SEQ ID NO: 3898 - protein, 111 aa, Homo sapiens
QSVLTQPPSVSGAPGQRVTISCTGSSSNFGAGYDVHWYQQLPGTAPKLLIYGNTNRPSGVPDRFSGSKSGTSASLAITGLQAEDEADYYCQSYDSSLSGGVFGGGTKLTVL

SEQ ID NO: 3899 - protein, 126 aa, Homo sapiens
QVQLVQSGAEVKKSGASVKVSCKASEYTFTSYDINWVRQATGQGLEWMGWMSPNSGNTGYAQKFQGRVTMTRNTSISTAYMELSSLKSEDTAVYYCARGGRNGIVVVLTSDAFDIWGQGTLVTVSS

SEQ ID NO: 3900 - protein, 106 aa, Homo sapiens
SYVLTQPPSMSVAPGKTARITCGGNNIGSNSVHWYQQKPGQAPVLVVYDDSDRPSGIPERFSGSNSGNTATLTISRVEAGDEADYYCQVWDSTTVVFGGGTKLTVL

SEQ ID NO: 3901 - protein, 120 aa, Homo sapiens
QVQLVQSGAEVKKPGSSVKVSCKASGGTFSSYALSWVRQAPGQGLEWMGGIIPIFGTTNYAQKFQGRVTITADESTSTAYMVLSSLRSEDTAVYYCARHSGYDRGHRDYWGQGTLVTVSS

SEQ ID NO: 3902 - protein, 109 aa, Homo sapiens
EIVLTQSPATVSLSPGERATLSCRASQSVSSFLDWYQQKPGQAPRLLIYDASNRATGIPARFSGRGSGTDFTLTISSLEPEDFAVYYCHHRNNWPPRLTFGGGTKVEIK

SEQ ID NO: 3903 - protein, 121 aa, Homo sapiens
QVQLVESGGGVVQPGRSLRLSCAASGFTFSIYAMHWVRQAPGKGLEWVAVISYDGINKYYADSVKGRFTISRDNSKNTLYLQMNSLRAEDTAVYYCARDMSGSYYGAFDSWGQGALVTVSS

SEQ ID NO: 3904 - protein, 105 aa, Homo sapiens
EIVLTQSPDFQSVTPKEKVTITCRASQSIGSTLHWYQQKPGQSPRLLIKYASQSISGVPSRFSGSGSGTDFTLTINSLEAEDAATYYCHQSSSFTFGPGTKVDIK

SEQ ID NO: 3905 - protein, 126 aa, Homo sapiens
QVQLVESGGGVVQPGRSLRLSCAASGFTFSSHVMHWVRQAPGKGLEWVAVISDDGSNKYYADSVKGRFTIFRDKSKNTLYLQMNSLRTEDTAVYYCARDYVVMVVPATFYYGMDVWGQGTTVTVSS

SEQ ID NO: 3906 - protein, 115 aa, Homo sapiens
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSVVVFGGGTKLTVL

SEQ ID NO: 3907 - protein, 121 aa, Homo sapiens
EVQLLESGGGLVQPGGSLRLSCAASGITFISYAMIWVRRAPGKGLEWVSGISGSGGSTDYADSVKGRFTISRDNSKNTLYLQMNSLRAEDTAVYYCAKAPTILRGVYFDYWGQGILVTVSS

SEQ ID NO: 3908 - protein, 110 aa, Homo sapiens
QSALTQPASVSGSPGQSITISCTGTSSDVGGNNYVSWYQQHPGKAPKLMIYDVINRPSGVSNRFSGSKSGNTASLTISGLQAEDEADYYCSSYTSSSTLVFGGGTSLTVL

SEQ ID NO: 3909 - protein, 124 aa, Homo sapiens
EVQLVESGGGLVQPGGSLRVSCAASGFTFSSYWMSWVRQAPGKGLEWVANIKQDGSEKYYVDSVKGRFTISRDNAKNSLYLQMNSLRAEDTAVYYCARVFDDFWSDYMGSFDYWGQGTLVTVSS

SEQ ID NO: 3910 - protein, 106 aa, Homo sapiens
SYELTQPPSVSVSPGQTASITCSGDKLGDEYASWYQRKPGQSPVMVIYQDTKRPSAIPERFSGSNSGNTATLTISGTQPMDEADYYCQTWDTSTVVFGGGTKLTVL

SEQ ID NO: 3911 - protein, 121 aa, Homo sapiens
QVQLVESGGGVVQPGRSLRLSCAASGFTFSSYATHWVRQAPGKGLEWVAVISYDGTNKYYADSVKGRFTISRDNSKNTLYLQMNSLRAEDTAVYYCARAWMGSYYYGMDVWGQGTTVTVST

SEQ ID NO: 3912 - protein, 107 aa, Homo sapiens
DIQMTQSPSSVSASVGDRVTIACRASQGISSWLAWYHQKPGKAPELLIYAASSLQSGVPSRFSGSGSGTDFTLTITSLQPEDFATYYCQQANSFPPTFGGGTKVEIN

SEQ ID NO: 3913 - protein, 129 aa, Homo sapiens
EVQLVESGGGVVRPGGSLRLSCAASGFTFDDYGMSWVRQAPGKGLEWVSGITWNGGSTGYADSVKGRFTISRDNAKNSLYLQMSSLSAEDTALYHCALILSPVPRYSGYDWAGDAFDIWGQGTMVTVSS

SEQ ID NO: 3914 - protein, 108 aa, Homo sapiens
SSELTQDPAVSVALGQTVRITCQGDSLRIYYANWYQQKPGQAPVLVIYDENNRPSGIPDRFSGSSSGNTASLTITGAQAEDEADYYCNSRDSSSNRVVFGGGTKLTVL

SEQ ID NO: 3915 - protein, 124 aa, Homo sapiens
EVQLVESGGGLVQPGGSLRLSCAASGFTFSSYEMNWVRQAPGKGLEWVSFISSSGSTIYYADSVKGRFTISRDNAKNSLYLQMNRLRAEDTAIYYCAREPQGPGYYYYYYMDVWGKGTTVTVSS

SEQ ID NO: 3916 - protein, 112 aa, Homo sapiens
QSALTQPASVSGSPGQSITISCTGMSSDVGSYNLVSWYQQHPGKAPKLMIYEVSKRPSGVSNRFSGSKSGNTASLTISGLQAEDEADYYCCSYAGRTTFPYVFGTGTKVTVL

SEQ ID NO: 3917 - protein, 127 aa, Homo sapiens
QVQLVESGGGVVQPGRSLRLSCAASGLTFSSYGMHWVRQAPGRGLEWVAVISFDGVNKYYEDSVKGRFTISRDNSKNTMYLQMNSLRAEDTAVYYCAKAYRGDMITFGGIIAPLDYWGQGTLVTVSS

SEQ ID NO: 3918 - protein, 111 aa, Homo sapiens
QSVLTQPPSVSGAPGQRVTISCTGSSSNIGAGYDVHWYQQLPGTAPKLLIYGSTNRPSGVPDRFSGSKSGTSASLAITGLQAEDEADYYCQSYDSSLSVLVFGTGTKVTVL

SEQ ID NO: 3919 - protein, 122 aa, Homo sapiens
QVQLVQSGAEVKKPGSSVKVSCKASGGTLSSYAISWVRQAPGQGLEWMGGIIPIFGTANYAQKFQGRVTITADESTSTAYMELSSLRSDDTAVYYCVRTMGYDSSGYYEDYWGQGTLVTVSS

SEQ ID NO: 3920 - protein, 109 aa, Homo sapiens
EIVLTQSPATLSLSPGERATLSCRASQSVSSFLAWYQQKPGQAPRLLIYDASNRATGIPARFSGSGSGTDFTLTISSLEPEDFAVYYCQQRSNWPPRLTFGQGTRLEIK

SEQ ID NO: 3921 - protein, 121 aa, Homo sapiens
QMQLVQSGAEVKKTGSSVKVSCKASGYTFTYRYLHWVRQAPRQALEWMGWITPFNSNTKYAQKFQDRVTITRDRSMSTAYMELSSLRSEDTAIYYCATHSEDFYYYYMDVWGKGTTVTVSS

SEQ ID NO: 3922 - protein, 110 aa, Homo sapiens
QSALTQPPSASGSPGQSVTISCTGTSSDVGGYNYVSWYQQHPGRAPKVMIYEVSKRPSGVPDRFSGSKSGNTASLTVSGLQAEDEADYYCSSYAGSNNLVFGGGTKLTVL

SEQ ID NO: 3923 - protein, 124 aa, Homo sapiens
EVQLSQSGGGLVQPGGSLRLSCEASGFTFKNYAMTWVRQAPGKGLEWVSSIYGSGGARYYADSVKGRFTISRDNSRNTLYLQLTDLGAADTAIYYCAKDRHADVLLWFGEVSHWGQGALVTVSS

SEQ ID NO: 3924 - protein, 111 aa, Homo sapiens
QSALTQPASVSGSPGQSITISCTGTINDIEIYKQVSWYQQKAGKVPELIIYEVTERPSGISARFSGSKSGNTASLTISGLQAEDEGDYYCCSYAGPGAFVLFGGGTKLTVL

SEQ ID NO: 3925 - protein, 128 aa, Homo sapiens
QVQLQESGPGLVKPSGTLSLTCAVSGGSISSSNWWSWVRQPPGKGLEWIGEIYHSGSANYNPSLKSRVTISVDKSKNQFSLRLNSVTAADTAVYYCARKSSAYSYRYAEPREYYFDYWGQGTLVTVSS

SEQ ID NO: 3926 - protein, 111 aa, Homo sapiens
QSVLTQPPSVSAAPGQKVTISCSGSSSNIGNNYVSWYQQLSGTAPKLLIYDNNKRPSGIPDRFSGSKSGTSATLGITGLQTGDEADYYCGTWDSSLSAFYVFGTGTKVTVL

SEQ ID NO: 3927 - protein, 121 aa, Homo sapiens
EVQVVESGGGLVQPGGSRRLSCTASGFTLSNYWMSWVRQAPGKGLEWVANIKQDGSEKYYVDSVKGRFTISRDNAKNSLYLQMDSLRAEDTAVYYCARGGRYCPGGSCPKWGRGTLVTVSS

SEQ ID NO: 3928 - protein, 108 aa, Homo sapiens
DIQMTQSPSSLSASVGDRVTITCQASQDISNFLNWYQQKPGEAPKLLIFDASKLETGVPSRFSGSGFGTDFTFTISSLQPEDIATYYCQQYDDLTSITFGQGTRLEIK

SEQ ID NO: 3929 - protein, 121 aa, Homo sapiens
QVQLVESGGGVVQPGKSLRLSCAASGFTFSSYDMHWVRQAPGKGLEWVAVIWSDGSNKYYADSVKGRFTISRDNSKNTLYLQMNSLRADDTAVYFCTRVAGHLGELSSDYWGQGTLVTVSS

SEQ ID NO: 3930 - protein, 106 aa, Homo sapiens
SYELTQPPSVSVSPGQTARITCSGDAFPNQYAYWYQQKPGQAPVLLIYKDSERPSGIPERFSGSSSGTTVTLTISGVQAEDEADYYCQSTDSSGMLFGGGTKLTVL

SEQ ID NO: 3931 - protein, 122 aa, Homo sapiens
QMQLVQSGPEVKKPGTSVKVSCEASGFTFISSAMHWVRQARGQRLEWIGRIVVGSGNTHYAQKFQERVTITRDMSKSAAYMELNSLRSEDTAVYYCAASGGDSGTYEIGEYWGQGTLVTVSS

SEQ ID NO: 3932 - protein, 113 aa, Homo sapiens
DIVMTQSPDSLAVSLGERATINCKSSQSVLYSSNNKNYLAWYQQQPGHPPKLLIYWASTRESGVPDRFSGSGSGTDFTLTITSLQAEDVAVYYCQQYFSSPPTFGQGTKLEIK

SEQ ID NO: 3933 - protein, 132 aa, Homo sapiens
QVQLQGSGPGLVKPPQTLSLTCTVSGGSISSGNYYWSWIRQPAGKGLEWIGRIYSSGSGNTKYNPSLKSRVTISVDTSKNQFSLKLSSVTAADTAVYYCASGEILLTAAGTEDYSYYGMDVWGQGTTVTVSS

SEQ ID NO: 3934 - protein, 106 aa, Homo sapiens; identical to SEQ ID NO: 3536

SEQ ID NO: 3935 - protein, 123 aa, Homo sapiens
QVQLQESGPGLVKPSETLSLTCTVSGVSISSYFWSWIRQPPGKGLEWIGYIYYTGSTNYNPSLKSRVTISVDTSKNQFSLKLSSVTAADTAVYYCARGDSSGWYGNPYHFDYWGQGTLVTVSS

SEQ ID NO: 3936 - protein, 110 aa, Homo sapiens
QSVLTQPPSASGTPGQRVTISCSGSSSNIGSNTVNWYQQLPTTAPKLLIYSNNQRPSGVPDRFSGSKSGTSASLSISGLQSEDEADYYCAAWDDSLNGPVFGGGTKLTVL

SEQ ID NO: 3937 - protein, 129 aa, Homo sapiens
EVQLLESGGGLVQPGGSLRLSCAASGFTFSNYAMSWVRQSPGMGLHWVSAISGSGGSTYYADSVKGRFTISRDNSKNTLYLQMNSLRAEDTAVYYCAKIPPYHYDILTGYQLPYYFDYWGQGTLVTVSS

SEQ ID NO: 3938 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGWVFGGGTRLTVL

SEQ ID NO: 3939 - protein, 126 aa, Homo sapiens
QVQLVQSGAEVKKPGSSVKVSCKASGGTFSSYGITWVRQAPGQGLEWMGRIIPILGIADYAQKFQGRVTITADKSTSTAYMELSSLRSEDTAFYYCAREGWDCSGGSCNDYYFDYWGQGTLVTVSS

SEQ ID NO: 3940 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVL

SEQ ID NO: 3941 - protein, 118 aa, Homo sapiens
EVQLVESGGGLVKPGGSLRLSCAASGFTFTSYSMNWVRQAPGKGLEWVSSISGGSSYIYYADSVRGRFTISRDNAKNSLYLQMNSLRAEDTAVYYCARGAGSYWFDYWGQGTLVTVSS

SEQ ID NO: 3942 - protein, 108 aa, Homo sapiens
EIVLTQSPGTLSLSPGERATLSCRASQSVSSNYLAWYQQKPGQAPRLLIYGASSRATGIPDRFSGSGSGTDFTLTISRLEPEDFAVFYCQQYAGSPLTFGGGTKVEIK

SEQ ID NO: 3943 - protein, 122 aa, Homo sapiens
EVQLLESGGGLVQPGGSLRLSCAASGFTFSSYAMSWVRQAPGKGLEWVSTISGSGGSTYYADSVKGRFTISRDNSKNTLYLQMNSLRAEDTAVYYCAKVTFGDLERLGWDYWGQGTLVTVSS

SEQ ID NO: 3944 - protein, 112 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNPGGMFGGGTKLTVL

SEQ ID NO: 3945 - protein, 131 aa, Homo sapiens
QLQLQESGPGLVQPSETLSLTCIVSGGSISSSSYYWGWIRQPPGKGLEWIGTIYYSGSTYYNPSLKSRVTISVDTSKNQFSLKLSSVTAADTALYYCARPHSYYYPSGSYHGRFLNWFDPWGQGTLVTVSS

SEQ ID NO: 3946 - protein, 112 aa, Homo sapiens
QSVLTQPPSVSGAPGQRVTISCTGSSSNIGAGYDVHWYQQLPGTAPKLLIYGNINRPSGVPDRFSGSKSGTSASLAITGLQAEDEADYYCQSFDSSLSGPVVFGGGTKLTVL

SEQ ID NO: 3947 - protein, 123 aa, Homo sapiens
EVQLVESGGVVVQPGGSLRLSCAASGFSFDDYTIHWVRQAPGKGLEWVSFVSWDGGSTYYADSVKGRFTISRDKSKKSLYLQMNSLRTEDTALYYCAREDSSGYPSVSYFDYWGQGTLVTVSS

SEQ ID NO: 3948 - protein, 108 aa, Homo sapiens; identical to SEQ ID NO: 3454

SEQ ID NO: 3949 - protein, 119 aa, Homo sapiens
QVQLVQSGAEVKKPGSSVKVSCKASGGTFSSYAISWVRQAPGQGLEWMGGIIPIFGTTNYAQKFQGRVTITADESTSTAYMELSSLRSEDTAVYYCAILRHVLQQLDYWGQGTLVTVSS

SEQ ID NO: 3950 - protein, 109 aa, Homo sapiens
EIVLTQSPATLSLSPGERATLSCRASQSVSSYLAWYQQKLGQAPRLLIYDASNRATGIPARFSGSGSGTDFTLTISSLEPEDFAVYYCQRGSNWPPRLTFGGGTKVEIK

SEQ ID NO: 3951 - protein, 125 aa, Homo sapiens
QLQLQESGPGLVKPSETLSLTCTVSGGSINSSTYYWGWIRQPPGKGLEWIGTIYYSGSTYYKSSLKSRVIISVDTSKNQFSLKLSSVTAADTAVYYCARVWGSSWRGRRWDFDPWGQGTLVTVSS

SEQ ID NO: 3952 - protein, 107 aa, Homo sapiens
DIQMTQSPSSLSASVGDRVTITCRASQSISNYLNWYQQEPGRAPKLLIYAASSLQSGVPSRFSGSGSETDFTLTISSLQPEDFATYHCQQSYSTPWTFGQGTKVEIK

SEQ ID NO: 3953 - protein, 127 aa, Homo sapiens
QVQLVESGGGVVQPGRSLRLSCAASGFTFSSYGMHWVRQAPGKGLEWVVVISYDANTKYYADSVKGRFTISRDNSKNTLNLQMNSLRAEDTAVYYCARAYRGEMITFGGVIAPLDYWGQGTLVTVSS

SEQ ID NO: 3954 - protein, 111 aa, Homo sapiens
QSVLTQPPSVSGAPGQRVTISCTGSSSNIGAGYDVFWYQQLPGTAPKLLIYGNSNRPSGVPDRFSGSKSGTSASLAITGLQAEDEADYYCQSYDSTLSVLVFGTGTKVTVL

SEQ ID NO: 3955 - protein, 124 aa, Homo sapiens
QVQLHQWGAGLLKPSETLSLTCAVYGGSFSGYYWSWIRQPPGKGLEWIGEINHSGNTNYNPSLKSRVTISVDTSKNEVSLKLSSVTAADTAVYYCARGLGAYSSRWFLSFFDYWGQGTLVTVSS

SEQ ID NO: 3956 - protein, 113 aa, Homo sapiens
DIVMTQSPDSLAVSLGERATISCKSSQTVLYRSSNKNYLAWYQQKPGQPPKLLIYWASTRESGVPDRFSGRGSGTDFTLTISSLQAEDVAVYYCQQYYSTPKTFGGGTKVEIK

SEQ ID NO: 3957 - protein, 117 aa, Homo sapiens
EVQLVESGGGLIQPGGSLRLSCAASGLTVSSNYMSWVRQAPGKGLEWVSVIYSGGSTYYADSVKGRFTISRDNSKNTLYLQMNSLRAEDTAVYYCARDLYVRGLDVWGQGTTVTVSS

SEQ ID NO: 3958 - protein, 106 aa, Homo sapiens; identical to SEQ ID NO: 1298

SEQ ID NO: 3959 - protein, 126 aa, Homo sapiens
EVQLVESGGGLVQPGGSLRLSCAASGFTFSSYYMNWVRQAPGKGLEWVSYISSGSSIIYYADSVKGRFTISRDNAKNSLYLQMNSLRDEDTAVYYCARDSPLRYFDWQLGGGFDYWGQGTLVTVSS

SEQ ID NO: 3960 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSLWVFGGGTKLTVL

SEQ ID NO: 3961 - protein, 126 aa, Homo sapiens
QVQLQESGPGLVKPSQTLSLTCTVSGGSISSGSNFWSWVRQPAGKGLEWIGRIFTTGSTNYNPSLKSRVTISLDRSKNQFSLKLSSVTAADTAVYYCARDEGSGSLLYYHYYMDVWGKGTTVTVSS

SEQ ID NO: 3962 - protein, 110 aa, Homo sapiens
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTKLTVL

SEQ ID NO: 3963 - protein, 124 aa, Homo sapiens
EVQLVESGGGLVKPGGSLRLSCAASGFTFSSYTMNWVRQAPGKGLEWLSSISSSRNYIYYADSVKGRFTISRDNAKNSLYLQMNSLRAEDTAVYYCARDGYSSSWYSYYYFDFWGQGTLVTVSS

SEQ ID NO: 3964 - protein, 112 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGSSTSYVVFGGGTKLTVL

SEQ ID NO: 3965 - protein, 124 aa, Homo sapiens
EVQLVESGGGLVQPGRSLRLSCAASGFTFDDYAMHWVRQAPGKGLEWVSGISWNSGSIGYADSVKGRFTISRDNAKNSLYLEMNSLRAEDTALYYCFSVPPLSLFGGTYWFDPWGQGTLVTVSS

SEQ ID NO: 3966 - protein, 111 aa, Homo sapiens
NFMLTQPHSVSESPGKTVTISCTRNSGSIARNYVQWYQQRPGSAPTTVIYEDNQRPSGVPDRFSGSIDSSSNSASLTISALKTEDEADYYCQSYDGSKFGVFGGGTKLAVL

SEQ ID NO: 3967 - protein, 125 aa, Homo sapiens
EVQLLESGGGLVQPGGSLRLSCAASGFTFSTYAMSWVRQAPGKGLEWVSGISGSGGSTYYADSVKGRFTISRDNSKNTLYLQMNSLRAEDTAVYYCAKDTGILLWFGELSGVDYWGQGTLVTVSS

SEQ ID NO: 3968 - protein, 111 aa, Homo sapiens
QSVLTQPPSVSGAPGQRVTISCTGSSSNIGARYDVFWYRQLPGTAPKLLIYGSNNRPSGVPDRFSGSKSGTSASLAITGLQAEDEADYYCQSYDSSLSGYVFGTGTKVTVR

SEQ ID NO: 3969 - protein, 124 aa, Homo sapiens
EVQLLESGGGLVQPGGPLRLACAVSGFTFSSYAMTWVRQAPGKGLEWVSSISGSGDNTYYADSVKGRFTISRDNSRNTLYLQMNSLRAEDTAVYYCAKVSSKWQYYYYYYMDVWGKGTTVTVSS

SEQ ID NO: 3970 - protein, 109 aa, Homo sapiens
EIVLTQSPGTLSLSPGDRATLSCRASQSVRISFLAWYQQKPGQAPRLLIYGASSRATGIPDRFSGNGSGTDFTLTISRLEPEDFAVYYCQHYGSSPPYTFGQGTKLEIK

SEQ ID NO: 3971 - protein, 115 aa, Homo sapiens
EVQLVESGGGLVQSGGSLRLSCAVSGFNVNSNYLSWVRQAPGKGLEWVSIIYSDGITYYADSVKGRFTISRDNSKNTLYLQLNSLRTEDTAVYFCARSAGYMDVWGKGTTVIVSS

SEQ ID NO: 3972 - protein, 106 aa, Homo sapiens
EIEMTQSPATLSVSPGERATLSCRASQSVSSNLAWYQQKPGQAPRLLIYGASTRATGIPARFSGSGSGTEFTLTISSLQSEDFAVYYCQQYNDWPSFGLGTKVEIK

SEQ ID NO: 3973 - protein, 121 aa, Homo sapiens
QVQLVESGGGLVKPGGSLRLSCAASGFTFSDYYMSWIRQAPGKGLEWVSYISSSTNTIYYADSVKGRFTISRDNAKNSVYLQMNSLRAEDTAVYYCARDRVVGARGDNDPWGQGTLVTVSS

SEQ ID NO: 3974 - protein, 110 aa, Homo sapiens
QSALTQPASVSGSPGQSITISCTGTSSDIGSYNLVSWYQQHPGKAPKLMIYEVSRRPSGVSNRFSGSKSGNTASLTISGLQAEDEADYYCCSYAGSSTSSFGGGTKLTVL

SEQ ID NO: 3975 - protein, 122 aa, Homo sapiens
EEQLLESGGDLVQPGGSLRLSCAASAFTFNNYAMSWVRQAPGKGLEWVSGISGSGNSTSYADSVKGRFTISRDSSKNTLYLQMNSLRAEDTAVYYCAKDLYQLPWGNAFDIWGQGTMVTVSS

SEQ ID NO: 3976 - protein, 109 aa, Homo sapiens
SYVLTQPPSVSVAPGKTARITCGGNNIGSKSVHWYQQKPGQAPVLVVYDDSDRPSGIPERFSGSNSGNTATLTISRVEAGDEADYYCQVWDGSSDPHWVFGGGTKLTVL

SEQ ID NO: 3977 - protein, 130 aa, Homo sapiens
QVTLRESGPALVKPTQTLTLTCTFSGFSLTTSGMCVSWIRQPPGKALEWLALIDWADDKYYSTSLKTRLTISKDTSKNQVVLTMTDMDPVDTATYYCARTRPTGYSGYDFGFPEAFFDPWGQGTLVTVSS

SEQ ID NO: 3978 - protein, 107 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPLTFGQGTKVEIK

SEQ ID NO: 3979 - protein, 128 aa, Homo sapiens
QLRLQESGPGLVKPSETLSLTCTVSGGSISSSNFYWGWIRQPPGKGLEWIGSIYYSGSTHYNPSLKSRVTVSVDTSKNQFSLKLSSVTAADTAVYYCARLTYYYDSSGFIRAEPFDYWGQGILVTVSS

SEQ ID NO: 3980 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSFLFTFGQGTKLEIK

SEQ ID NO: 3981 - protein, 119 aa, Homo sapiens
QITLKESGPPLVEPKQTLRLTCSFSGFSLTTNGEAVGWIRQPPGKALEWLALIHWDDDKWYSPSLRNRLTITRDTSKNQVVLTMTNVDPVDTATYYCAHRAVILNFDHWGQGLLVTVSS

SEQ ID NO: 3982 - protein, 107 aa, Homo sapiens
FYELTQPPSVSVSPGQTAGITCSGDKLGHKYVYWYQQKPGQSPILLIYQDDKRPSGIPERFSGSNSGTIATLTISGTQPVDEADYYCQAWDNDAGVVFGGGTKLTVL

SEQ ID NO: 3983 - protein, 126 aa, Homo sapiens
QVQLVQSGSELKEPGASVKVSCKTTGHSFDSYAINWVRQAPGQGLEWMGWLNTHTGRPTYVQGLTGRYVFSLDTSVSTAYLEINSLETEDTAFYYCARGPMVALDQRLAFNYFDPWGQGTLVTVSA

SEQ ID NO: 3984 - protein, 110 aa, Homo sapiens
NFILTQPHSVSESPGKTIIISCTGAGGNIASNYVQWYRQRPGSAPTTVIFEDDQRPSGVPDRFSGSINASSNSASLTITGLRTEDEADYYCQSFGNNNVLFGGGTRLTVL

SEQ ID NO: 3985 - protein, 126 aa, Homo sapiens
QLQLQESGPGLVKPSETLSLTCTVSGGSISSSTYYWGWIRQPPGKGLEWIASIYYSGGTYYNPSLKSRVTISVDTSKNQYSLKRSSVTAADTAVYYCARLPDFWSGRAGYYYMDFWGKGTTVTVSS

SEQ ID NO: 3986 - protein, 110 aa, Homo sapiens; identical to SEQ ID NO: 3406

SEQ ID NO: 3987 - protein, 126 aa, Homo sapiens
EVQLVASGGGVVQPGGSLRLSCAVSGFTFDDYAMHWVRQVPGKGLKWVSLISGDGDSTYYADSVKGRFTISRDNSKNSLYLQMNSLRSEDTAFYYCAKDISSWDQLLSVLSAFDIWGQGTMVTVSS

SEQ ID NO: 3988 - protein, 107 aa, Homo sapiens
DIQMTQSPSSLSASVGDRVTITCQASQDISNFLNWYQQKPGKAPKLLIYDTSNLETGVPSRFSGSGSGTDFTFTISSLQPEDIATYYCQQFDNLPLTFGGGTKVEIK

SEQ ID NO: 3989 - protein, 119 aa, Homo sapiens
QVQLVQSGAEVKKPGASVKVSCKASGYTFTAYAIHWVRQAPGQGLEWMGRINSGTGDTKYSQKFQGRVTITRATTASTAYMELSSLRSEDTAVYYCARSPTVLLAFDYWGQGSLVTVSS

SEQ ID NO: 3990 - protein, 107 aa, Homo sapiens
DIQMTQSPSTLSASVGDRVTITCRASQSISSWLAWHQQKPGKVPKLLIYKASSLESGVPSRFSGSGSGTEFTLTISSLQPDDFATYFCQQYNSDPLTFGGGTKVEIK

SEQ ID NO: 3991 - protein, 117 aa, Homo sapiens
QVQLQESGPGLVKPSETLSLTCTVSGGSISSNYWSWIRQPPGKGLEWIGYIYYSGNTNYNPSLKSRVTISVDTSKNQFSLKLSSVTAADTAVYFCARTPLFYTMDVWGQGTTVTVSS

SEQ ID NO: 3992 - protein, 108 aa, Homo sapiens
EIVLTQSPGTLSLSPGERATLSCRASQSVSSSYLAWYQQKPGQAPRLLIYGASSRATGSPDRFSGSGSGTDFTLTISRLEPEDFAVYYCQQYGSSPYTFGQGTKLEIK

SEQ ID NO: 3993 - protein, 121 aa, Homo sapiens
QVQLVQSGAEVKKPGASVKVSCKVSGYTLPELSIHWVRQTPGKGLEWMGGFDPEDGETIYAQKFQGRVTMTEDTSTDTAYMDLSSLRSEDTAVYYCATSTALLPKYWFDPWGQGTLVTVSS

SEQ ID NO: 3994 - protein, 110 aa, Homo sapiens
QSVLTQPPSVSAAPGQKVTISCSGSSSNIGNNYVSWYQQLPGTTPKLLIYDNNERPSGIPDRFSGSKSGTSATLGITGLQTGDEADYYCGTWDSSLSAVVFGGGTTLTVL

SEQ ID NO: 3995 - protein, 127 aa, Homo sapiens
QLQLQESGPGLVKPSETLSLTCTISGASVSTNTYHWGWVRQPPGKGLEWIATFYNTGATLSNPSLKSRVTIALDTSKNQFSLNLISVTAADTAVYYCARHKKCNGHDCISNWYFEVWGRGTLVSVSS

SEQ ID NO: 3996 - protein, 111 aa, Homo sapiens
QSALTQPPSASGSPGQSVTISCTGTSSVIGANNYVSWYQQHPGKAPKLLIYDVDKRPSGVPDRFSGSKSGNTASLTVSGLQAEDEADYYCSTYVDNNSPALFGGGTKLTVL

SEQ ID NO: 3997 - protein, 128 aa, Homo sapiens
EVQLVQSGAEVKKPGESLKISCKGSGYSFTNYWIGWVRQMPGKGLEWMGIIYPVDSDTRYSPSFQGQVTMSADKSINTAYLQWSSLKASDTAMYYCARRPRGLDYYGSGSPLGYFDYWGQGTLVTVSS

SEQ ID NO: 3998 - protein, 106 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYKSYWTFGQGTKVEIK

SEQ ID NO: 3999 - protein, 125 aa, Homo sapiens
QVTLRESGPALVKPTQTLTLTCTFSGFSLSTIGMCVNWIRQPPGKALEWLARIDWTDDTNYSPSLRTRLTISKDTSKNQVVLTMTNMDPADTATYFCVRIRGLESGFDYYGMDVWGPGTTVTVSS

SEQ ID NO: 4000 - protein, 107 aa, Homo sapiens
DIQMTQSPSFVSASVGDRVTISCRASQDISTWLAWYQQKPGKAPKLLIFGANSLQSGVPSRFSGSGSGTDFTLTISSLQPEDFASYFCQQAKSFPLTFGGGTKIEIK

SEQ ID NO: 4001 - protein, 121 aa, Homo sapiens
QMQLQESGPGLVKPSETLSLTCNVFRGSIAIHYWSWIRQPPGKRLEWIGFMHPNGTTNYNPSLRSRVALSIDTSRSQFSLRLTSVTAADTAVYFCAKSTPGRTWKDPFDLWGQGTLVAVSS

SEQ ID NO: 4002 - protein, 108 aa, Homo sapiens
EIVLTQSPGTLSLSPGERATLSCRASQTISTDFLAWYQQKRGQAPRLLIFATSVRATGIPDRFIGSGSGTDFTLTISRVEAEDFAMYYCQQYDTSPRTFGQGTAVDFK

SEQ ID NO: 4003 - protein, 129 aa, Homo sapiens
QVQLQEAGPGLVKPSETLSLTCTVSGDSISSSNKHWGWFRQPPGEGLEWIGTIFSTGTTYSRSSLKSRVTLSVDTSKNQFSLKLISVTAADTAVYWCVRQPSWERGGTLFPDYFGLEVWGQGTTVSVSS

SEQ ID NO: 4004 - protein, 112 aa, Homo sapiens
DIVMTQSPLSLPVTPGEPASISCRSSQSLLNSNGHNYLDWYLQKPGQSPQLLIYLGFHRASGVPDRFSGSGSGTDFTLKISRVEAEDVGMYYCMQARQAPPTFGQGTRVEIK

SEQ ID NO: 4005 - protein, 121 aa, Homo sapiens
QVQLVESGGGVVQPGRSLRLSCAASGFTFNIYAMHWVRQAPGKGLEWVAVISYDGDNQYYSDSVKGRFTISRDNSKNTLYLLMNSLRAEDSALYYCARPQGGNYFQALDYWGQGTLVTVSS

SEQ ID NO: 4006 - protein, 107 aa, Homo sapiens
EIVLTQSPGTLSLSPGDRATLSCRASQSVSSSYLAWYQQKPGQAPRLLIYGASSRATGIPDRFSGTGSGTDFTLTISRLEPEDFAVFFCQRYGISYTFGQGTKLEIK

SEQ ID NO: 4007 - protein, 122 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHSTLVATILGFHYWDQGTLVTVSS

SEQ ID NO: 4008 - protein, 108 aa, Homo sapiens
SYELTQPPSVSVSPGQTASITCSGDKLGDKYVCWYQQKPGQSPVLVIYQDSKRPSGIPERFSGSNSGNTATLTISGTQAMDEADYHCQAWDSSTASYVFGTGTKVTVL

SEQ ID NO: 4009 - protein, 120 aa, Homo sapiens
QVQLVESGGGVVQPGRSLRLSCAASGFTFSSYGMHWVRQAPGKGLEWVAVIFYDGSNKYYADSVKGRFTISRDNSKNTLYLQMNSLRPEDTAVYYCARDLEWSSSGEAYWGQGTLVTVSS

SEQ ID NO: 4010 - protein, 108 aa, Homo sapiens
SYELTQPPSVSVSPRQTARITCSGDALPKKYAYWYQQKSGQAPVLVIYEDSKRPSGIPERFSGSSSGTMATLTISGAQVEDEADYYCYSTDSSGNHWVFGGGTKLTVL

SEQ ID NO: 4011 - protein, 127 aa, Homo sapiens
EVQLVESGGGLVKPGGSLRLSCAASGFILSPYSMNWVRQAPGKGLEWVSSISSSTSYIHYADSVKGRFTISRDNAKNSLYLQMNSLRAEDTAVYYCARDLDISDWQSFFYYYGMDVWGQGTTVTVSS

SEQ ID NO: 4012 - protein, 108 aa, Homo sapiens
SSELTQDPAVSVALGQTVRITCQGDSLRSYFASWYQQKPRQAPILVIYGKYTRPSGIPDRFSGSSLGNTASLTITGAQAEDEADYFCNSRDSSAHHVVFGGGTKLTVL

SEQ ID NO: 4013 - protein, 128 aa, Homo sapiens
EVQLVESGGGLVKPGGSLRLSCAASGFTFSNAWMSWVRQAPGKGLEWVGRIKSKTEGGTTDYAVPVKGRFTIARDDSKNTLYLQMNSLKTEDTAVYYCTTGSGYYDISAYYQYYFDYWGQGTLVTVSS

SEQ ID NO: 4014 - protein, 109 aa, Homo sapiens
SYELTQPPSVSVSPGQTARITCSGDALPKQYAYWYQQRPGQAPVLVIYKDSERPSGIPQRFSGSSSGTTVTLTISGVQAEDEADYYCQSGDSSGTYGVVFGGGTKLTVL

SEQ ID NO: 4015 - protein, 125 aa, Homo sapiens
EVQLVESGGGLVQPGRSLRLSCAASGFTFDYYAMHWVRQAPGKGLEWVSGISWNSDSIAYADSVKGRFTISRDSAKNSLYLQMNSLRAEDTALYYCARDLGPPHCTGGICYPDYWGQGTLVTVSS

SEQ ID NO: 4016 - protein, 110 aa, Homo sapiens
QSALTQPASVSGSPGQSITISCTGTSSDVGGYNYVSWYQQHPGKAPKLMIFDVSKRPSGVSNRFSGSKSGNTASLTISGLQAEDEADYYCSSYTSSITWVFGGGTKLTVL

SEQ ID NO: 4017 - protein, 121 aa, Homo sapiens
QVQLVQSGAEVKKPGASVKVSCKVSGYTLIELSMHWVRQAPGEGLEWMGGFDPEDGETIYAQKFQGRVTMTEDTSTDTAYMELSSLRSEDTAVYYCATSAAVKRMIWFDPWGQGTLVTVSS

SEQ ID NO: 4018 - protein, 108 aa, Homo sapiens
QSALTQPRSVSGSPGQSVTISCTGTSSDLGGYNFVSWYQQHPGEAPKLMIYDVAKRPSGVPDRFSGSKSGNTASLTISGLQAEDEADYYCSSYAGIWVFGGGTKLTVL

SEQ ID NO: 4019 - protein, 128 aa, Homo sapiens
RVQLVQSGAEVRKPGASVRVSCKVSGYSLSELSMHWVRQAPGKGLEWMGGFDPEDGETVYAQRFQGRVSMTEDISTDTAHMELSSLRSDDTAVYYCASGGLNGDYVTGGAYYYYMDVWGKGTTVTVSS

SEQ ID NO: 4020 - protein, 112 aa, Homo sapiens
DIVMTQSPLSLPVTPGEPASISCRSSQSLLHSNGYNYLDWYLQKPGQSPQLLFYLGSNRASGVPDRFSGSGSGTDFTLKISRVEAEDVGVYYCMQALQTPRTFGQGTRLEIK

SEQ ID NO: 4021 - protein, 125 aa, Homo sapiens
QVQLVQSGSELKKPGASVKVSCKASGYTFTSYAMNWVRQAPGQGLEWMGWINTNTGNPTYAQDFTGRFVFSLDTSVSTAYLHISSLKAEDTAVYYCARDQDTKYPTYYYYYMDVWGKGTTVTVSS

SEQ ID NO: 4022 - protein, 112 aa, Homo sapiens
DIVMTQTPLSLSVTPGQPASISCKSSQSLLHGDGKTYLYWYLQKPGQSPQLLIYEVSNRFSGVPDRFSGSGSGTDFTLKISRVEAEDVGIYYCMQSIQLPLTFGGGTKVDIK

SEQ ID NO: 4023 - protein, 122 aa, Homo sapiens
QVQLQESGPGLVKPSQTLSLTCSVSGASISSGSHYWSWVRQPAGKGLEWIGRIYTSGNSNYNPSLKSRIIMSVDTSKNQFSLKLTSVSAADTAVYFCAREGQSYYSFYMDVWGKGTTVTVSS

SEQ ID NO: 4024 - protein, 110 aa, Homo sapiens
QSVLTQPPSASGTPGQRVTIACSGTSSNIESNTVSWYQQLPGTAPTLLIYGDNQRPSGVPDRFSGSKSGTSASLAISGLQSEDEADYFCASWDDSLNGPVFGGGTKLTVL

SEQ ID NO: 4025 - protein, 129 aa, Homo sapiens
EVQLVESGGGLVRPGGSLRLSCAASGFTFSSYEMNWVRQAPGKGLEWVSYIGSSGSTIYYADSVKGRFTISRDNAKNSLYLQMNSLRAEDTAVYYCARDIAAAGSARRGYYYYFYMDVWGKGTTVTVSS

SEQ ID NO: 4026 - protein, 109 aa, Homo sapiens
EIVLTQSPATLSLSPGERATLSCRASQSVSSNLAWYQQKPGQAPRLLIYDASNRATGIPARFSGSGSGTDFTLTISSLEPEDFAVYYCQQRSNWPPRYTFGQGTKLEIK

SEQ ID NO: 4027 - protein, 128 aa, Homo sapiens
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARPIFSGYCNSFSCYIGYFQHWGQGTLVTVSS

SEQ ID NO: 4028 - protein, 111 aa, Homo sapiens
NFMLTQPHSVSESPGKTVTISCTRSSGSIASNYVQWYQQRPGSVPTTVIYEDNQRPSGVPDRFSGSIDSSSNSASLTISGLKTEDEADYYCQSYDSSNRGVFGGGTKLTVL

SEQ ID NO: 4029 - protein, 122 aa, Homo sapiens
QVQLVQSGAEVKKPGSSVKVSCKASGGTFSSYAITWVRQAPGQGLEWMGGIIPIFGTANYAQKFQGRVTITADESTSTTYMELSSLRSEDTAVYYCSKLGGYDSRGWTFDYWGQGTLVTVSS

SEQ ID NO: 4030 - protein, 109 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRRNWPPALTFGGGTKVEIK

SEQ ID NO: 4031 - protein, 124 aa, Homo sapiens
QITLQESGPTLVKPTQTLTLTCAFSGFSLSTNGVRVGWIRQPPGKALEWLAIVSWDNNDHYNPSLRNRLTLTRDTSKSQIVLTMTNMDPVDTGTYYCAHRRAFSSEWYDWFHPWGQGTLVTVSS

SEQ ID NO: 4032 - protein, 107 aa, Homo sapiens
EIVLTQSPATLSLSPGERVALSCRASQNIENTLGWYQQKPGQAPRLLISDASTRATGTPARFTGSGSGTDFTLSISSLEPEDFAVYYCQQRYRWPLTFGGGTKVEVR

SEQ ID NO: 4033 - protein, 119 aa, Homo sapiens
QITLKESGPPLVEPKQTLRLTCTFSGFSLTTNGEAVGWIRQPPGKALEWLALIYWDDDKRYSPSLRNRLTITRDTSKNQVVLTMTNVDPVDTATYYCAHRAVILNFDHWGQGLLVTVSS

SEQ ID NO: 4034 - protein, 107 aa, Homo sapiens
FYELTQPPSVSVSPGQTAGITCSGDKLGHKYAYWYQQKPGQSPILLIYQDGKRPSGIPERFSGSNSGTIATLTISGTQPVDEADYYCQAWDNDAGVVFGGGTKLTVL

SEQ ID NO: 4035 - protein, 125 aa, Homo sapiens
QVQLVQSGSELKKPGASVKVSCKASGYTFTTYAINWVRQAPGQGLEWMGWINTNTGNPTYAQDFTGRFVFSLDTSVSTAYLQISSLKTEDTAVYYCARDGMIVVPQYYYYYMDVWGKGTTVTVSS

SEQ ID NO: 4036 - protein, 112 aa, Homo sapiens
DIVMTQTPLSLSVTPGQPASISCKSSQNLLHSDGKTYLYWYLQKPGQSPQLLIYELSDRFSGVPDRFSGSGSGTDFTLKISRVEAEDVGVYYCMQSIQLPITFGQGTRLEIK

SEQ ID NO: 4037 - protein, 122 aa, Homo sapiens
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCAKRGKGGADPFFDYWGQGTLVTVSS

SEQ ID NO: 4038 - protein, 111 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYASSLSGVVFGGGTKLTVL

SEQ ID NO: 4039 - protein, 121 aa, Homo sapiens
QVQLVESGGGVVQPGRSLRLSCAASGFTFNSYGMHWVRQAPGKGLEWVAVISYDGSNKYYADSVKGRFTISRDNSKNTLYLQMNSLRAEDTAVYYCARTSSGNYRGGFDPWGQGTLVTVSS

SEQ ID NO: 4040 - protein, 106 aa, Homo sapiens
DIQMTQSPSTLSASVGDRVTITCRASQTISSWLAWYQQKPGKAPKLLIYKASSLESGVPSRFSGSGSGTEFTLTISSLQPDDFATYYCQQYNSYWTFGQGTKVEIK

SEQ ID NO: 4041 - protein, 123 aa, Homo sapiens
QVQLVQSGAEVKKPGASVKVSCKVSGYTLSELSIHWVRQAPGKGLEWMGGFDPEDVETIYAQRFQGRVTMTEDTSTDTAYMELSSLRSDDTAVYYCATAPATTVVAGHWFDPWGQGTLVTVSS

SEQ ID NO: 4042 - protein, 111 aa, Homo sapiens
QSVLTQPPSASGTPGQRVTISCSGSSSNIGSNTVNWYQQLPGTAPNLLIYSNNQRPSGVPDRFSGSKSGTSASLAISGLQSEDEADYYCAAWDDSLNGRWVFGGGTKLTVL

SEQ ID NO: 4043 - protein, 120 aa, Homo sapiens
QVQLVESGGGVVQPGRSLRLSCAGSGFTFSSYAMHWVRQAPGKGLEWVALISYDGSNKYYANSVMGLFTISRDNSKNTLYLQMNTLTAEDTAVYYCAKGFAGSYWYFDLWGRGTLVTVSS

SEQ ID NO: 4044 - protein, 106 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRSSWLTFGGGTKVEIK

SEQ ID NO: 4045 - protein, 121 aa, Homo sapiens
QVQLVQSGAEVKKPGASVKVSCKVSGYTLIELSIHWVRQAPGKGLEWMGGFDPEDGETIYAQKFQGRVTMTEDTSTDTAYMELSSLRSEDTAVYYCATTLAMYRVNWFDPWGQGTQVTVSS

SEQ ID NO: 4046 - protein, 112 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCNSYTNSSTPVYVFGTGTKVTVL

SEQ ID NO: 4047 - protein, 116 aa, Homo sapiens
QVQLVESGGGVVQPGRSLRLSCAASGFTFNNYGMHWVRQAPGKGLEWVAVIWYDGSSEHYADSVKGRFTISRDNSKNTLYLQMNSLRAEDTAVYYCARGPYSGDVWGQGTTVTVSS

SEQ ID NO: 4048 - protein, 110 aa, Homo sapiens
QSVLTQPPSASGAPGQRVTISCSGSSSNIGSNTVNWYQHLPGTAPKLLIYSNNKRPSGVPDRFSGSKSGTSASLAISGLQSEDEADYYCAAWDDSLNGWVFGGGTKLTVL

SEQ ID NO: 4049 - protein, 125 aa, Homo sapiens
QEQLVQSGSELKKPGASVKISCKASGYTFIKFAMNWVRQAPGQGLEWMGWINTNTGNPTLAQGFTGRFVFSLDTSLNTTYLQINSLKSEDTAVYFCARTALYSKRHLTYNYLAPWGQGTLVTVSS

SEQ ID NO: 4050 - protein, 109 aa, Homo sapiens
EIVLTQSPGTLSLSPGERATLSCRASQSVRSSDLAWYQQRPGQAPRLLIYGASSRVTGISDRFSASGSGTDFTLTISRLEPEDFAVYYCQHYGGSPHLTFGGGTKVEIK

SEQ ID NO: 4051 - protein, 119 aa, Homo sapiens
EVQLVESGGGLVQPGRSLRLSCAASGFTFDDYAMHWVRQAPGKGLEWVSGISWNSGSIGYADSVKGRFTISRDNAKNSLYLQMTSLRAEDTALYYCAKDSPGGMKYAYWGQGTLVTVSS

SEQ ID NO: 4052 - protein, 112 aa, Homo sapiens
DIVMTQTPLSLSVTPGQPASISCKSSQSLLHSEGKTYLYWYVQKPGQSPQLLIYEVSNRFSGVPDRFSGSGSGTDFTLKISRVEAEDVGVYYCMQSIQVPRTFGQGTKVEIK

SEQ ID NO: 4053 - protein, 118 aa, Homo sapiens
QVQLVESGGGVVQPGRSLRLSCAASGSTFSTYGMHWVRQAPGKGLEWVAVVSYDGSNKYYADSVKGRFTISRDNSKNTLYLQVNSLRAEDTAVYYCAKDLSLGGMDVWGQGTTVTVSS

SEQ ID NO: 4054 - protein, 113 aa, Homo sapiens
DIVMTQSPDSLAVSLGERATINCKSSQSVLNSSQNKNSLAWYQQKPGQPPKLLIYWASTRESGVPDRFSGSGSGTDFTLTISSLQAEDVAVYYCQQHYSTPFTFGPGTKVHIK

SEQ ID NO: 4055 - protein, 122 aa, Homo sapiens
EVQLVESGGGLVQPGGSLRLSCAASGFTFSSYWMHWVRQAPGKGLVWVSRINSDVSSTTYADSVKGRFTISRDNAKNTLYLHMNSLRAEDTAVYYCARQGPFSRYYYGMDVWGQGTTVTVSS

SEQ ID NO: 4056 - protein, 110 aa, Homo sapiens
QSVLTQPPSVSGAPGQRVTISCTGSSSNIGAGYDVHWYQQLPGTAPKLLIYGNFNRPSGVPDRYSGSKSGTSASLAITGLQAEDEADYYCQSYDTSLSVVFGGGTKLTVL

SEQ ID NO: 4057 - protein, 116 aa, Homo sapiens
EVQLLESGGGLVQPGGSLRLSCAASGFTFSSYAMNWVRQAPGKGLDWVSGISGSGDITYYADSVKGRFTISRDNSKNTLYLQMNSLRAGDTAVYYCAKLDKAGMAWGQGTLVTASS

SEQ ID NO: 4058 - protein, 113 aa, Homo sapiens
DIVMTQSPDSLAVSLGERATINCKSSQSVLYSSNNKNQLAWYQQKPGQPPKVLIYWASTRESGVPDRFSGSGSGTDFTLTISSLQAEDVAVYYCHQYYSTPYTFGQGTKLEIK

SEQ ID NO: 4059 - protein, 118 aa, Homo sapiens
QVQLVESGGGVVQPGRSLRLSCAASGFTFSSYGMHWVRQAPGKGLEWVAVISYDGSNKYYADSVKGRFTISRDNSKNTLYLQMNSLRPEDTAVFYCAKEDYVAGMDVWGQGTAVTVSS

SEQ ID NO: 4060 - protein, 113 aa, Homo sapiens
DIVMTQSPDSLAVSLGERATINCKSSQSVLYSSTNKNHLAWYQQKPGQPPKLLIYWASTRESGVPDRFSGSGSGTDFSLTISSLQAEDVAVYYCQQYYSIPRTFGQGTKVEIK

SEQ ID NO: 4061 - protein, 123 aa, Homo sapiens
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDLMWAAGPGLDGADWGQGTLVTVSS

SEQ ID NO: 4062 - protein, 108 aa, Homo sapiens
SYELTQPPSVSVSPGQTARITCSGDALPKKYTYWYQQKSGQAPVLVIYEDSKRPSGIPERFSGSSSGTMATLTISGAQVEDESDYYCYSTDSSGNHWVFGGGTKLTVL

SEQ ID NO: 4063 - protein, 121 aa, Homo sapiens
QIQLVESGGGVVRPGRSLSLSCAGTGFALSNYATHWVRQAPGKGLEWVAVMSFDGKSEYFADSVKGRVTLSRDNSKNTLNLQLNRLRVDDTAVYFCARSRGVVVNHGLDVWGQGTTVTVAS

SEQ ID NO: 4064 - protein, 110 aa, Homo sapiens
QSELTQPPSASGTPGQRVIISCSGGTSNIGSNSVHWYQQLPGTAPKLLIHSDNERPSGVPDRISGSKSGTSSSLAISGLQSEDEAHYYCATWDDSLKGWVFGGGTKLSVL

SEQ ID NO: 4065 - protein, 125 aa, Homo sapiens
QVQLVQSGAEVKKPGSSVKVSCKASGGTFSSYTISWVRQAPGQGLEWMGRFIPILDIPNYAQKFQGRVTITADKSTSTAYMELSSLRSEDTAVYYCARDQRRPGTVLTYNWFDPWGQGTLVTVSS

SEQ ID NO: 4066 - protein, 111 aa, Homo sapiens
QSALTQPRSVSGSPGQSVTISCTGTSSDVGGYDYVSWYQQHPGKAPKLMIFDVSKRPSGVPDRFSGSKSGNTASLTISGLQAEDEADYYCCSYAGSYTLDVFGTGTKVTVL

SEQ ID NO: 4067 - protein, 121 aa, Homo sapiens
QVQLQESGPGLVKPSQTLSLTCTVSGGSISSGDYYWSWIRQPPGKGLEWIGYIYYSGSTYYNPSLKSRVTISVDTSKNQFSLKLSSVTAADTAVYYCARAPVVGDDAFDLWGQGTMVTVSS

SEQ ID NO: 4068 - protein, 107 aa, Homo sapiens
SSELTQDPAVSVALGQTVRITCQGDSLRDYYARWYQQKPGQAPVLVIYGKNNRPSGIPDRFSGSSSGNTDSLTITGAQAEDEADYYCNSRDSSGSHLFGGGTKLTVL

SEQ ID NO: 4069 - protein, 122 aa, Homo sapiens
QVQLVQSGAEVKKPGSSVKVSCKASGGTFSTYAITWVRQAPGQGLEWMGGFIPIFGTANYAQKFQGRVTITADESTSTAYMELSSLRSEDTAVYFCAGHLHYDSSGYHHDYWGQGTLVTVSS

SEQ ID NO: 4070 - protein, 109 aa, Homo sapiens
EIVLTQSPATLSLSPGERATLSCRASQSVSNFLAWYQQKPGQAPRLLIYDASNRATGIPARFSGSGSGTDFTLTISSLEPEDFAVYYCQQRSNWPPRITFGQGTRLEIK

SEQ ID NO: 4071 - protein, 118 aa, Homo sapiens
QITLKESGPTLVKPTQTLTLTCTFSGLSLTTGRVGVGWIRQPPGKALQWLAVTYGNDGKLYSPSLKSRLTITEDTSKSHVVLTVTNVDPVDTGTYYCAHHTIRGVKDWGQGTLVTVSS

SEQ ID NO: 4072 - protein, 109 aa, Homo sapiens
SYVLTQPPSVSIAPGKTASLSCGGNNLATKSVYWHQQKPGQAPVLVVYDDSDRPSGIPERFSGSKSGTTATLTISRVEAGDEADYYCQVWDSMSDSHVVFGGGTKLTVL

SEQ ID NO: 4073 - protein, 120 aa, Homo sapiens
QVHLVQSGAEVTKPGASVKVSCKTSGYTFTSYDFIWVRQAPGKGLEWLGWINTNSGTTDYAQKFQGRVSMTRNTSTSTVYMELSGLRSDDTAFYFCARTFTFGYRVADFWGQGTQVTVSS

SEQ ID NO: 4074 - protein, 107 aa, Homo sapiens
EIVLTQSPGTLSVSPGERATLSCRASQTVTSNYIAWYQQKPGQAPRLLIHGASSRATGVPDRFSGSGSGTDFTLTITRLEPDDFGLYHCQQYGTSPTFGQGTKVEIK

SEQ ID NO: 4075 - protein, 121 aa, Homo sapiens
QVQLVESGGGVVQPGRSLRLSCAASGFTFSSYAMHWVRQAPGKGLEWVAIISYDGSNKYYADSVKGRFTISRDNSKNTLYLQMNSLRAEDTAVYYCARARGGSYRGPFDYWGQGTLVTASS

SEQ ID NO: 4076 - protein, 106 aa, Homo sapiens; identical to SEQ ID NO: 1106

SEQ ID NO: 4077 - protein, 122 aa, Homo sapiens
QVQLVQSGAEVKKPGSSVKVSCKASGGTFSSYAISWVRQAPGQGLEWMGGIIPIFGTAKYAQKFQGRVTITADESTSTAYMELSSLRSEDTAVYYCAKSYSYDSSGYYSDFWGQGTLVTVSS

SEQ ID NO: 4078 - protein, 109 aa, Homo sapiens
EIVLTQSPATLSLSPGERATLSCRASQSVSSFLAWYQQKPGQAPSLLIYDASNRATGIPARFSGSGSGTDFTLTISSLEPEDFAVYYCQHRSNWPPKLTFGGGTKVEIK

SEQ ID NO: 4079 - protein, 132 aa, Homo sapiens
EVQLVESGGGLVQPGGSLRLSCAASGFTFSSYWMSWVRQAPGKGLEWVANIKEDGSEKYYVDSVKGRFTISRDNAKNSLYLQMNSLRAEDTAVYYCARCVVTFTIFGVAQRKGPYSYYMDVWGKGTTVTVSS

SEQ ID NO: 4080 - protein, 109 aa, Homo sapiens
SSELTQDPAVSVALGQTVRITCQGDSLRSYYASWYQQKPGQAPLLVIYGEINRPSGIPDRFSGSGSGNTASLTITGAQAEDEADYYCNSRDSSGNLNWVFGGGTKLTVL

SEQ ID NO: 4081 - protein, 119 aa, Homo sapiens
QVTLKESGPALVKPTQTLTLTCTFSGFSLTTSEMRASWIRQPPGKAPEWLARIDGEDDKFYSTSLKTRLTISKDSSKNQVVLTMTNMEPADTATYYCARGPIRGYFDYWGQGSLVTVSS

SEQ ID NO: 4082 - protein, 104 aa, Homo sapiens
EIVLTQSPAILSLSPGERATLSCRASQTVTSTFLAWYQQKPGQAPRLLIHGASTRATGIPDRFSGSGSGTDFTLIISRLEPEDFAVYYCQQYGAFGQGTKVEIK

SEQ ID NO: 4083 - protein, 126 aa, Homo sapiens
QVQVVQSGAELKKPGASVKLSCKASGYTFTKYYVHWVRQAPGQGLQWLGVINPSGRGTSYGQNFQGRVTLTRDTSTNTVYMEVTSLTSEDTAVYYCARGEPVARGPYYYQYHMDLWGTGTTVTVSS

SEQ ID NO: 4084 - protein, 110 aa, Homo sapiens
QSVLTQPPSASGTPGQRVTISCSGNNSNIGRNTVNWYQQLPGTAPTLLIFSNDQRPSGVPDRFSGSKSGTSGSLAISGLQTEDEADYYCATWDDGLNGVVFGGGTKLTVL

SEQ ID NO: 4085 - protein, 126 aa, Homo sapiens
QVQLVESGGGLVQPGRSLRVSCVASGFSFSNFAMDWVRQAPGKGLEWVAVLSHDGRNSHYADSVKGRFTISRDNSKNTLFLQMNSLRPEDTAVYYCAKNLQPYCASTSCPDAFDVWGQGTMVTVSS

SEQ ID NO: 4086 - protein, 107 aa, Homo sapiens
DIQMTQSPSTLSASIGDRVTITCRASQSVSSWLAWYQQRPGKAPKLLISKASNLESGVPSRFSGSGSRTEFTLTISSLQPGDFATYYCQQYNLYPYTFGQGTTLEIK

SEQ ID NO: 4087 - protein, 125 aa, Homo sapiens
QVQLVQSGAEVKKPGASVKVSCKASGYNFTSYGISWVRQAPGQGLEWMGGISAYKDNTNYAQKFQGRVTMTTDTSTSTAYMELRSLRSDDTAVYYCARERGPLRFLEWGLSTDYWGQGTLVTVSS

SEQ ID NO: 4088 - protein, 107 aa, Homo sapiens
DIQMTQSPSSLSASVGDRVTITCRASQGIRHYLAWYQQRPGKVPKLLIYAASTLQSGVPSRFSGSGSGTDFTLTISSLQPEDVATYYCQKYNSAPLTFGPGTKVDVK

SEQ ID NO: 4089 - protein, 123 aa, Homo sapiens
QVQLVESGGGVVQPGRSLRLSCAASGFTFSSYGMHWVRQAPGKGLEWVAVISYDGSNKYYADSVKGRFTISRDNSKNTLSLQMNSLRAEDTAVYYCAKAWDIVVVVAAGPDYWGQGTLVTVSS

SEQ ID NO: 4090 - protein, 117 aa, Homo sapiens
QSALTQPASVSGSPGQSITISCTGTSSDVGSYNLVSWYQQHPGKAPKLMIYEVSKRPSGVSNRFSGSKSGNTASLTISGLQAEDEADYYCCSYAGSSNAGSSTSRVVFGGGTKLTVL

SEQ ID NO: 4091 - protein, 119 aa, Homo sapiens
QITLKESGPTLVKPTHTLTLTCTFSGFSLSTNGEAVGWIRQPPGKPLEWLALIYWDDDKRYSPSLKSRLTITRGTPKNQVVLTMTNMDPVDTATYYCAHRAVLLNFDSWGPGTLVTVSS

SEQ ID NO: 4092 - protein, 107 aa, Homo sapiens
SYELTQPPSVSVSPGQTASITCSGDKLGDKYAYWYQQRPGQSPLLVIYQDHKRPSGVPERFSGSNSGNTATLTISGTQAMDDADYYCQAWDNIAGVVFGGGTKLTVL

SEQ ID NO: 4093 - protein, 122 aa, Homo sapiens
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCARGAAALYYYYMDVWGKGTTVTVSS

SEQ ID NO: 4094 - protein, 106 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSSSTPRFGQGTKVEIK

SEQ ID NO: 4095 - protein, 118 aa, Homo sapiens
EVQLLESGGGLVQPGGSLRLSCAASGFSLTANFMNWVRQAPGQGLEWVSTISNTGAVTDYAESVKGRFTISRDISKNTLYLQMTSLGADDTAMYYCAKDLHWYGMDVWGPGTTVTVSS

SEQ ID NO: 4096 - protein, 110 aa, Homo sapiens
RSVLTQPPSVSAAPGQTVTISCSGGLANVGENFVSWYQQFPGTAPKLLTYDNNRRPSGIPDRFSGSKSGTSATLGITGLQTGDEADYYCGAWDSGLRAVVFGGGTKLTVL

SEQ ID NO: 4097 - protein, 117 aa, Homo sapiens
QVQLVESGGGVVQPGRSLRLSCAASGFTFSTYGIHWVRQAPGKGLEWVAVIWYDGSNKYYADSVKGRFTISRDNSKNTVYLQMNSLRAEDTAVYYCARDEMVNLDYWGQGTLVTVSS

SEQ ID NO: 4098 - protein, 106 aa, Homo sapiens
SYELTQPPSVSVSPGQTARITCSGDALPKKYAYWYQQKSGQAPVLVIYEDSKRPSGIPERFSGSSSGTMATLTISGAQVEDEADYYCYSTVSSGNRFGTGTQVTVL

SEQ ID NO: 4099 - protein, 127 aa, Homo sapiens
QLQLQESGPGLVKSSETLSLTCSVSGGSLISRSYYWAWVRQPPGKGLEWIASIDYSGSTFDNPSLRGRVTISVDTSKKQFSLKLKSVTAADTAVYFCARQTKVGTPFGEFLYYFDYWGQGTLVPVSS

SEQ ID NO: 4100 - protein, 108 aa, Homo sapiens
DIQMTQSPSSLSASVGDRVTITCRASQSITRHLNWYQQKPGKAPKLLIYAASTLHTGVPSRFSGSGSGTDFTLTIHSLQPEDFATYYCHQSYNTPPATFGGGTRVEIK

SEQ ID NO: 4101 - protein, 131 aa, Homo sapiens
EVQLVESGGGLVKPGGSLRLSCAASGFTFSGYTMNWVRQAPGKGLEWVSSISSSSSYIYYADSVKGRFTISRDNAKNSLYLQMNSLRVEDTAMYYCARDRVNYGDVLIGPEALYYYGMDVWGQGTTVTVSS

SEQ ID NO: 4102 - protein, 111 aa, Homo sapiens
QSVLTQPPSVSAASGQKVTISCSGSSSNIGNNYVSWYQQLPGTAPKLLIYDNNKRPSGIPDRFSGSKSGTSATLGITGLQTGDEADYYCGTWDSSLSAGGVFGGGTKLTVL

SEQ ID NO: 4103 - protein, 119 aa, Homo sapiens
QVQLQESGPGLVKPSQTLTLTCTFSDDSFISGSYYWSWIRQPAGKGLEWIGRIHRSGNTFYNPSLRSRVTISLDRSKKHFSLNLSSVTAADTAVYYCAREIGEGYLDSWGQGTLVTVSS

SEQ ID NO: 4104 - protein, 110 aa, Homo sapiens
QSVLTQPPSASGTPGQRVTISCSGSSSNIGSNYVYWYQQLPGTAPKLLIYRNVQRPSGVSDRFSGSKSGTSASLAVSGLRSEDEADYYCATWDDYLSGVVFGGGTKLTVL

SEQ ID NO: 4105 - protein, 129 aa, Homo sapiens
EVQLVESGGGLVEPGRSLRLSCAASGFIFDDYAMHWVRQAPGKGLEWVSGISWDSGSIAYADSVKGRFTISRDNAKNSLYLQMNSLRAEDTALYYCAKDKGLGYCSSASCYKEHYMDVWGQGTTVTVSS

SEQ ID NO: 4106 - protein, 109 aa, Homo sapiens
SYVLTQPPSVSVAPGKTARITCGGNNIGSKSVHWYQQKPGQAPVLVVYDDSDRPSGVPERFSGSNSGNTATLTISRVEAGDEADYYCQVWDSSSDHLYVFGTGTKVTVL

SEQ ID NO: 4107 - protein, 117 aa, Homo sapiens
QVQLVESGGGVVQPGRSLRLSCAASGFTFSNYGMHWVRQAPGKGLEWVALISYDGSNKYYADSVKGRFTISRDNSKNALYLQMNSLRAEDTAVYYCARGGSDTFGYWGQGTLVTVSS

SEQ ID NO: 4108 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCETWDSSLSGYVFGTGTKVTVL

SEQ ID NO: 4109 - protein, 123 aa, Homo sapiens
QVQLVESGGGVVQPGRSLRLSCAASGFTFSTYGMHWVRQAPGKGLEWVALISYDGSNKYYADSVKGRFTISRDKSKNTLYLQMNSLRAEDTAVYYCAKDASIVVVPVGYFQHWGQGTLVTVSS

SEQ ID NO: 4110 - protein, 110 aa, Homo sapiens
QSALTQPASVSGSPGQSITISCTGTTSDVGRYDYVSWYQQHPGKAPKLMIYDVSNRPSGVSNRFSGSKSGNTASLIISGLQAEDEADYYCSSYTSSRRRVFGGGTKLTVL

SEQ ID NO: 4111 - protein, 119 aa, Homo sapiens
EVQVVESGGGLVQPGGSLRLSCEASGITFSTHWMTWVRQAPGKGLEWVANVGLDVSERQYVGAVRGRFTISRDNAKNSLYLQMDSLRVDDMGVYYCGSFVAGSGRVDYWGQGSLVIVSS

SEQ ID NO: 4112 - protein, 108 aa, Homo sapiens
DVQMTQSPSTLSASVGDRVTITCRASQIVYSTWLAWYQQKPGKAPKLLIYKASTLANGVPSRFSGSASGAEFTLAISSLQPDDFATYSCQQYHYLPWTFGQGTKVEIK

SEQ ID NO: 4113 - protein, 123 aa, Homo sapiens
QVQLVQSGAEVKKPGSSVKVSCKASGGTFSSYAISWVRQAPGQGLEWMGGIIPIFGTGNYAQRFQGRVTITADESTSTAYMELSSLRSEDTAVYYCARHYYNDGSDYYPIDYWGQGTLVTVSS

SEQ ID NO: 4114 - protein, 109 aa, Homo sapiens
EIVLTQSPATLSLSPGERATLSCRASQSVSNFLAWYQQKPGQAPRLLIYDASNRATGIPARFSGSGSGTDFTLTISSLEPEDFAVYYCHQRSNWPPALTFGGGTKVEIK

SEQ ID NO: 4115 - protein, 124 aa, Homo sapiens
EVQLLESGGGLVQPGGSLRLSCAASGFTFSSYAMTWVRQAPGKGLEWVSAISGSGGSTYYADSVKGRFTISRDISKNTLYLQMNSLRAEDTAVYYCAKLTKPYCSGGRCYVDYWGQGTLVTVSS

SEQ ID NO: 4116 - protein, 106 aa, Homo sapiens
EIVMTQSPATLSVSPGERATLSCRASQSVSNNLAWYQQKPGQAPRLLIYGASTRATGIPARFSGSGSGTEFTLTISSLQSEDFAVYYCQQYNNWPTFGGGTKVEIK

SEQ ID NO: 4117 - protein, 125 aa, Homo sapiens
QVQLVESGGGVVQPGRSLRLSCAASGFTFSSFGMHWVRQAPGKGLEWVAVISYAGSDEYYVDSVKGRFTISRDDSKNTLYLQMNSLRAEDTAVYYCAKDFGGDNTAMVEYFFDYWGQGTLVTVSS

SEQ ID NO: 4118 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSFMFGQGTKVEIK

SEQ ID NO: 4119 - protein, 128 aa, Homo sapiens
QVQLVQSGAEVKKPGASVKVSCKVSGYSLTELGIHWVRQAPGKGLEWMGGFDPEYGETIYAQKFQGRVTMTEDTSTDTAYLELSSLRSEDTAMYYCAGGGLYGDYVTGGAYYYYMDVWGRGTTVTVSS

SEQ ID NO: 4120 - protein, 112 aa, Homo sapiens
DIVMTQSPLSLPVTPGEPASISCRSSQSLLHSNGYNYLDWYVQKPGQSPQLLIYLGSNRASGVPDRFSGSGSGTDFTLKISRVESEDVGVYWCMQALQTPRTFGQGTRLEIK

SEQ ID NO: 4121 - protein, 120 aa, Homo sapiens
QVQLQESGPGLVKPSQTMSLTCTVSGGSFSTGTFYWNWIRQHPGKGLEWIGSIHPHGSLYYNPSLKGRAIISEDTSRNQFSLNLALVTAADTAVYYCARGLDSYKLGDLWGRGTLVTVSS

SEQ ID NO: 4122 - protein, 113 aa, Homo sapiens
DIVMTQSPDSLAVSLGERATINCKSSRNILYSVNNENYVSWYQQKPGQPPRLLIFWASRRASGVPDRFTGSGSGTDFTLTITSLQAEDVAVYYCQQNYASPWTFGLGTKVEVK

SEQ ID NO: 4123 - protein, 120 aa, Homo sapiens
EVQLVESGGGLVQPGGSLRLSCAASGFTFSSYEMNWVRQAPGKGLEWVSYISNSGSTIYYADSVKGRFTISRDNAKNSLYLQMNSLRAEDTAVYYCARVRIRYYYYMDVWGKGTTVTVSS

SEQ ID NO: 4124 - protein, 110 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEAEYYCQSYDDSLRGVFGTGTKVTVL

SEQ ID NO: 4125 - protein, 124 aa, Homo sapiens
QVQLEQSGAEVKKPGASVKVSCKASGYTFSSYNVQWIRLAPGLGLEWMGWINAGNGNTKYSQKFQGRVTLTRDTSASTAYMELSSLRFEDTAVYYCAREYYDFWSGYSPSFLFSGQGTVVTVSS

SEQ ID NO: 4126 - protein, 110 aa, Homo sapiens
QSVLTQPPSVSAAPGQKVTISCSGTTSNIGTNYVSWYQLLPGKAPNLLIYDTDKRPAGIPDRFSGSKSGASATLGITGLHTGDEADYYCVTWDSRLSAVIFGGGTKLSVL

SEQ ID NO: 4127 - protein, 123 aa, Homo sapiens
EVQLVESGGGLVQPGRSLRLSCAASGFMFDGYAMHWVRQAPGKGLEWVSGISWNSGTIGYADSVKGRFTISRDNAKNSLYLQMNSLRPEDTALYYCAKDGRPAAIYFYYMDVWGKGTPVTVSS

SEQ ID NO: 4128 - protein, 110 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTPVFGGGTKLTVL

SEQ ID NO: 4129 - protein, 129 aa, Homo sapiens
QVQLVQSGAEVKKPGASVKVSCKASGYTFTNYAMQWVRQAPGQRLEWMGWINAGNSNTKYSEKFQGRVTITSDTYASTAYMELSSLRTEDTAVYYCARAPIHSAYSSGWYHYYYGMDVWGQGTTVTVSS

SEQ ID NO: 4130 - protein, 107 aa, Homo sapiens
DIQMTQSPSSLSASVGGRVTITCRASQGISNYLAWFQQKPGKAPKSLIYAASSLQSGVPSKFSGSGSGTDFTLTISSLQPEDFATYYCQQYNSYPITFGQGTRLEIK

SEQ ID NO: 4131 - protein, 116 aa, Homo sapiens
EVQLEESGGGLVQPGGSLRLSCAASGFIFSDYSMNWVRQAPGKGLEWVAFINSNSRSIYYADSVKGRFTISRENAKNSLYLQMSSLSDEDTALYYCARWGNGMDVWGQGTTVTVSS

SEQ ID NO: 4132 - protein, 107 aa, Homo sapiens
SYELTQPPSVSVSPGQTARITCSGDALPKQFAYWYQQKPGQAPLLLISKDSERPSGIPERFSGSSSGTAVTLTISGVQAEDEADYYCQSVDSSGSYVFGTGTKVTVL

SEQ ID NO: 4133 - protein, 122 aa, Homo sapiens
QVQLQESGPRLVKPSQTLSLTCTVSGGSISSGSYYWSWIRQPAGKGLEWIGRIYSSGSTNYNPSLKSRVTLSVDTSKNQFSLKVTSVTAADTALYYCARGAAALYYYYMDVWGKGTTVTVSS

SEQ ID NO: 4134 - protein, 106 aa, Homo sapiens
DIQMTQSPSSLSAFVGDRVTITCRASQSISNYLNWYQQKPGKAPKLLIYAASSLQSGVPSRFSGSGSGTDFTLTISSLQPEDFATYYCQQSSSTPRFGQGTKVEIK

SEQ ID NO: 4135 - protein, 131 aa, Homo sapiens
QVQLQESGPGLVKPSQTLSLSCTVSGDSVRSDTSSWTWIRQPAGKGLEWIGQIDPSGSTTDNPSFYSRVTFSVDRSKNQFSLHLSSVTAADTAIYFCARNMRRTRCYSIEDCRFVYYIDVWGRGTTVTVSS

SEQ ID NO: 4136 - protein, 107 aa, Homo sapiens
DIQMTQSPSSLSASVGDSVTFTCRASQGISRNLNWYQYKPGKAPILLIYSASSLQSGVPSRFSGSGSETDFTLTINSLQPEDFATYYCQQSSSTPWTFGQGTKVEVK

SEQ ID NO: 4137 - protein, 126 aa, Homo sapiens
QVQLVQSGSELKKPGASVKVSCKASGYTFTSYAMNWVRQAPGQGLEWMGWINTNTGNPTYAQGFTGRFVFSLDTSVSTAYLQISSLKADDTAVYYCARDHDLNFQLEYFYYYMDVWGKGTTVTVSS

SEQ ID NO: 4138 - protein, 112 aa, Homo sapiens
DLVMTQTPLSLSVTPGQPASISCKSSQSLLHSDGKTYLYWYLQKPGQSPQLLIYEVSNRFSGVPDRFSGSGSGTDFTLKISRVEAEDVGVYYCMQSIQLPLTFGGGTKVEIK

SEQ ID NO: 4139 - protein, 122 aa, Homo sapiens
QVQLQESGPGLVKPSQTLSLTCTVSGGSISSGSYYWSWIRQPAGKGLEWIGRIYTSGNTNYSPSLKSRVTISVDTSKNQFSLKLSSVTAADTAVYYCARGPAATYYYYMDVWGKGTTVTVSS

SEQ ID NO: 4140 - protein, 106 aa, Homo sapiens
DIQMTQSPSSLSASVGDRVTITCRASQTINNYLNWYQQKPGKAPKVLIYAASSLQSGVPSRFSGSGSGTDFTLTISSLQPEDFASYYCQQSYSNLTFGGGTKVEIK

SEQ ID NO: 4141 - protein, 124 aa, Homo sapiens
QVQLVQSGAEVKKPGSSVKVSCKASGGTVSSYAITWVRQAPGQGLEWMGGIIPIFGTANYAQKFQVRVTITADESTSTAYMELSSLRSEDTAVYYCARLYYDWGTTVATFADYWGQGTLVTVSS

SEQ ID NO: 4142 - protein, 109 aa, Homo sapiens
EIVLTQSPATLSLSPGERATLSCRASQSISSYLAWYQQKPGQAPRLLIYDASNRATGIPARFSGSGSGTDFTLTISSLEPEDFAVYYCQQRSNWPPVLTFGGGTKVEIK

SEQ ID NO: 4143 - protein, 123 aa, Homo sapiens; identical to SEQ ID NO: 4127

SEQ ID NO: 4144 - protein, 108 aa, Homo sapiens
EIVLTQSPGTLSLSPGERATLSCRASQSLSSSYLAWYQQRPGQAPRLLIYGASSRATGIPDRFSGSGSGTDFTLTISRLEPEDFAVYYCQQYGSSPGTFGQGTKVEIK

SEQ ID NO: 4145 - protein, 123 aa, Homo sapiens
EVQLLQSGGGLVQPGGSLRLSCVASGFTLSNYAMTWVRQAPGKGLEWVSAISTSGGNTHYIDSVKGRFTISRDNSKHTVSLQMNSLRAEDTAVYYCATTNYYSGSPVITRDCWGQGTLVTVSS

SEQ ID NO: 4146 - protein, 107 aa, Homo sapiens
DIQMTQSPSSLSASVGDRVTITCRASQSIGKYLSWYQHKPGKAPNLLIFGASTLYSGVPSRFSGGGSGTDFTLTISSLQPEDFAAYYCQQSSLSPYTFGQGTKLEIK

SEQ ID NO: 4147 - protein, 130 aa, Homo sapiens
QVQLQESGPGLVKPSQTLSLTCDVSGESIRSGRYFWGWIRQRPGKGLEWCGYIYYTGNTYYNPSLKSQIRISADTSKNQVSLKLFSVTAADTAVYYCAGVGIQTTGFVGHPKAGGFVDYWGQGALVIVSS

SEQ ID NO: 4148 - protein, 107 aa, Homo sapiens
QIVMTQSPATLSVSPGERATLSCRASQSVSSNLAWYQQKPGQAPRLLIYGASAGAAGVPARFSGSGSGTEFTLTISSLQSEDFAVYFCQQYNKWPWTFGQGTKVEIK

SEQ ID NO: 4149 - protein, 130 aa, Homo sapiens
QLQLQESGPGLVKPSETLSLTCTVSGGSISSSSYYWGWIRQPPGKGLEWIGSIYYSGTTYYNPSLKSRVTISVDTSKNQFSLKLSSVTAADTAVYYCATLHYGTTYGRWYSFYYYGMDVWGQGTTVTVSS

SEQ ID NO: 4150 - protein, 113 aa, Homo sapiens
DIVMTQSPLSLPVTPGEPASISCRSSQSLLHSNGNNYLDWYLQKPGQSPQLLIYLGSNRASGVPDRFSGSGSGTDFTLKISRVEAEDVGVYYCMQALQTWGYTFGQGTKLEIK

SEQ ID NO: 4151 - protein, 120 aa, Homo sapiens
QVQLVQSGAEVKKPGASVKVSCKASGYTFTNFGVSWVRQAPGHGLEWVGYISAYTGYTNHAQRLQGRVTMTTDTSTSTAYMELRSLTFGDTALYYCARTKGAGTEDLDYWGQGTLVTVSS

SEQ ID NO: 4152 - protein, 106 aa, Homo sapiens
SYEVTQPPSVSVSPGQTANITCSGDGLGDRYTYWYQQKSGQSPVLVIYQDSERPSGIPERFSGSNSGNTATLTISGTQAMDEADYYCQAWDISTVVFGGGTKLSVL

SEQ ID NO: 4153 - protein, 117 aa, Homo sapiens
EVQLVESGGGLVKPGGSLRLSCAASGFTFTNAWMSWVRQAPGKGLQWVGRIKSKTDGGTADYAAPVKGRFTISRDDSKNTLYLQMNSLKTEDTAVYYCTTDPWFDPWGQGTLVTVSS

SEQ ID NO: 4154 - protein, 108 aa, Homo sapiens
SSELTQDPAVSVALGQTVRITCQGDSLRNYYASWYQQKPGQAPLLVISGNSHRPSHIPDRFSGSSSGNTASLTITGAQAVDEADYYCHSRDSSGNHVLFGGGTKLTVL

SEQ ID NO: 4155 - protein, 119 aa, Homo sapiens
QVQLQESGPGLVKPSQTLSLTCAVSGASISSGNYFWTWIRQPPGKGLEWIGYIYYTGSTYFNPSLKSRLTMSVDTSKNQFSLKLSSVTAADTAVYYCARATNSGAYFSWGQGTLVTVSS

SEQ ID NO: 4156 - protein, 111 aa, Homo sapiens
QSVLTQPPSVSGAPGQRVTISCTGNSSNIGAGYALHWYQQLPGTAPKLLISDNIDRPSGVPDRFSGSKSGTSASLAITGLQAEDEADYFCQSFDIAVSAWVFGGGTKLTVL

SEQ ID NO: 4157 - protein, 122 aa, Homo sapiens
QVRLVQSGAEVKKPGASVKVSCKVSGYTLPELSIHWVRQAPGKGLEWMGGFDPEDGEAIYAQKFQGRVTMTEDTSTDTAYMNLSSLRSEDTAVYYCTTTTVLSGSSYWFDPWGQGTLVTVSS

SEQ ID NO: 4158 - protein, 103 aa, Homo sapiens
EIVLTQSPATLSLSPGERATLSCRASQSVSSYLAWYQQKPGQAPRLLIYDASNRATGIPARFSGSGSGTDFTLTISSLEPEDFAIYYCQQRYTFGQGTNLEIK

SEQ ID NO: 4159 - protein, 131 aa, Homo sapiens
QVQLVQSGAEVKKPGSSVKVSCKASGGTFSSYAISWVRQAPGQGLEWMGGIIPIFGTPNYAQKLQGRVTITADESTSTITADEFTSTVYMELSSLRSEDTAVYYCVTVLGYDSSGFWIDYWGQGTLVTVSS

SEQ ID NO: 4160 - protein, 109 aa, Homo sapiens
EIVLTQSPATLSLSPGERATLSCRASQSISSYLAWYQQTPGQAPRLLIYDASNRATGIPARFSGSGSGTDFTLTISSLEPEDFAVYYCQQRSNWPPRLTFGGGTKVEIK

SEQ ID NO: 4161 - protein, 121 aa, Homo sapiens
QVQLVESGGGVVQPGRSLRLSCAASGFIFSSYAIHWVRQAPGKGLEWVAVISYDGSNKYYADSVKGRFTISRDNSKNTLFLQMNSLRAEDTAVYYCARGDVDTARVDFDYWGQGTLVTVSS

SEQ ID NO: 4162 - protein, 110 aa, Homo sapiens
QSVLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGPVFGGGTKLTVL

SEQ ID NO: 4163 - protein, 120 aa, Homo sapiens
QVQLVQSGAEVKKPGASVKVSCKASGYTFTTFGVTWVRQAPGHGLEWVGYISAYTGYTNHAQRLQGRVTLTTDTSTSTAYMELRSLTFGDTALYYCARTKGAGTEDLDYWGQGTLVTVSS

SEQ ID NO: 4164 - protein, 106 aa, Homo sapiens
SYEVTQPPSVSVSPGQTANITCSGEGLGDRYTYWYQQKSGQSPVLVIYQDSARPSGIPERFSGSSSGNTATLTISGTQAMDEADYYCQAWDISTVVFGGGTKLSVL

SEQ ID NO: 4165 - protein, 128 aa, Homo sapiens
QVQLVESGGGVVQPGRSLRLSCAASGFTFSRYGMHWVRQAPGKGLEWVAVISYDGSNKNYAGSVKGRFTISRDNSKNTLYLQMNSLRAEDTAVYYCAKEPHIGYSRGWTYYYYGMDVWGQGTTVTVSS

SEQ ID NO: 4166 - protein, 112 aa, Homo sapiens
DIVMTQTPLSLSVTPGQPASISCKSSQSLLHSDGKTYLYWYLQKPGQSPQLLIYEVSNRFSGVPDRFSGSGSGTDFTLKISRVEAADVGVYYCMQSIQLPLTFGQGTRLEIK

SEQ ID NO: 4167 - protein, 129 aa, Homo sapiens
QVQLQESGPGLVKPSETLSLTCTVSGGSISGYYWSWIRQSPGKGLEWIGYIYYSGSTDYNPSLKSRVTISVDTSKNQLSLNLSSVTAADTAVYYCARDQGGDDFWSGYFRRYYYYMDVWGKGTTVTVSS

SEQ ID NO: 4168 - protein, 107 aa, Homo sapiens
EIVLTQSPATLSLSPGERGTLSCRASQSVSNHLAWYQQKPGQAPRLLIYDASNRATGIPARFSGSGSGTDFTLTISSLEPEDFAVYFCQQRSNWPLTFGGGTKVEIK

SEQ ID NO: 4169 - protein, 124 aa, Homo sapiens
QVQLQQWGAGLLKPSETLSLTCAVYGGSFSGYYWTWIRQPPGKGLEWIGEINHNGSTNYNPSLKSRVTISVDTSKNQFSLKLSSVTAADTALYYCARARGGLVIIFSYYYMDVWGKGTTVTVSS

SEQ ID NO: 4170 - protein, 109 aa, Homo sapiens
SSELTQDPAVSVALGQTVRITCQGDSLRTYYPSWYQQKPGQAPVLVISDKNNRPSGIPDRFSGSSSGNTASLTITGAQAEDEADYYCNSRDSSGNHPVVFGGGTKLTVL

SEQ ID NO: 4171 - protein, 120 aa, Homo sapiens
QVQLVQSGAEVKKPGASVKVSCKASGYTFTAYGISWVRQAPGQGLEWMGWISAYNGDTNYAQKVQDRVTMTTETSTSTAYMELRSLKSDDTAVYYCAKGLYYGPTACDYWGQGTLVTVSS

SEQ ID NO: 4172 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQHYNSYPWTFGQGTKVEIK

SEQ ID NO: 4173 - protein, 116 aa, Homo sapiens
QVLLVQSGAEVKKPGSSVKVSCKASGGTFSSYAISWVRQAPGQGLEWMGGIIPIFGTANYAQKFQGRVTLTADEYTAYMDLSSLRSEDTAIYYCARDLVVGATGGWGQGTLVTVSS

SEQ ID NO: 4174 - protein, 109 aa, Homo sapiens
EIVLTQSPATLSLSPGERATLSCRASQTVSSFLAWYQQKPGQAPRLLIYDASNRATGIPARFSGSGSGTDFTLTISSLEPEDFAVYYCQQRNNWPPRLTFGGGTKVEIK

SEQ ID NO: 4175 - protein, 115 aa, Homo sapiens
QVQLLQSGAEVEKPGASVKVSCKASGYTFTSYAVHWVRQAPGQRPEWMGWINAGNGNTKYSRRFQGRVSLTSDTSASTAYMELSSLRSEDTAVYYCASGSRVDFWGPGTMVTVSS

SEQ ID NO: 4176 - protein, 108 aa, Homo sapiens
EIVLTQSPGTLSLSPGESATLSCRASQSVSSNYLAWYQQKPGQAPRLLIYGASSRATGIPDRFSGSGSGTDFTLTISRLEPEDFAVYYCQQYGTSPRTFGQGTKVEIK

SEQ ID NO: 4177 - protein, 125 aa, Homo sapiens
QVQLVQSGAEVKKPGASVKVSCKASGYSFNMYAMHWVRQAPGQRLEWMGWINPGKKNTEFSEKFQGRVTISRDTTASTVYMELRSLTSEDTALYFCARSFSNSGSYEGGYQFDFWGQGTLVTVSS

SEQ ID NO: 4178 - protein, 107 aa, Homo sapiens
EVVMTQSPATLSVSPGEGATLSCRASQSIGSKLAWYQQKPGQAPRLLIYGASTRATGIPARFRGSESGTEFTLTISRLQSEDFAVYFCHQYNNWPLTFGGGTKVEIK

SEQ ID NO: 4179 - protein, 114 aa, Homo sapiens
QLQLQESGPGLVKPSETLSLTCTISSSSNYYWGWIRQSPGKGLEWIGSMFYSGSTHYNPSLKSRVTISVDTSKNQFSLELTSVTAADTAVYYCARQEGGWFPYWGQGTLVTVSS

SEQ ID NO: 4180 - protein, 109 aa, Homo sapiens
EIVLTQSPATLSLSPGERATFSCRASQRVRSYLAWYQQKPGQAPRLLIYDASNRATGIPARFSGSGSGTDFTLTISSLEPEDFAVYYCQQRGTWPPVFTFGPGTKVDMK

SEQ ID NO: 4181 - DNA, 369 bp, Homo sapiens
gaggtgcacctgttggagtctgggggaggcttagtgcggcctggggggtccctgagactctcctgtgcagcctctgaattcacctttggcaactatgccatgacctgggtccgccaggctccaggaaaggggctggagtgggtctcagttatttttggcagtggcactggcacatattatggagactccgtgaagggccgattcaccgtttccagagataattccaagaacacactgtatctgcaaatgaacagcctgagagccgacgacacggccgtatattactgtgcgaaattagcaggggtccaacacctgatctactggtacttcgatctctggggccggggcaccctggtcactgtctcttca

SEQ ID NO: 4182 - DNA, 327 bp, Homo sapiens
gaaatagtgttgacacagtctccagccaccctgtctttgtctccaggggaaagagccaccctctcctgcagggccagtcagagtgttggctcctccttagcctggtaccaacagaaagctggccaggctcccaggctcctcatctatgatgcattcaatagggccattggcatcccagccaggttcagtggcagtgggtctgggacagacttcactctcaccatcagcagcctggagcctgaagattttgcagtttattactgtcagcagcgtgacaactggcctccggaggtcactttcggcggagggaccaaggtggagatcaag

SEQ ID NO: 4183 - DNA, 375 bp, Homo sapiens
cagctgcaactgcaggagtcgggcccaggactggtgaagccttcggagaccctgtccctcacctgctctgtctctggtgcctccatcagcagtgttagttactactgggggtggatccgccagcccccagggaaggggctggagtggattggggctatctattatactgggaacacctactacaactcgtccctcaagagtcgagtcaccatatccgtagacacgtccaagaaccacttctccctgaagctgacctctgtgaccgccgcagacacggctgtgtattattgtgcgagagttgatcgggccatcagccgttactcgctaaactggttcgacccctggggccagggaaccctggtcaccgtctcctca

SEQ ID NO: 4184 - DNA, 327 bp, Homo sapiens
gaaatagtgatgacgcagtctccagccaccctgtctgtgtctccgggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcaacagtataataactggcctcccctgtacacttttggccaggggaccaagctggagatcaaa

SEQ ID NO: 4185 - DNA, 363 bp, Homo sapiens
gaggtgcagctggtggagtctggaggaggcttgatccaacctggggggtccctgagactctcctgtgcagcctctgggctcaccgtcagtagcaactacatgagctgggtccgccaggctccagggaaggggctggagtgggtctcagttatttatagcggtggttccacatactacgcagactccgtgaagggccgattcaccatctccagagacaattccaagaacacgctgtatcttcaaatgaacagcctgagagccgaggacacgggcgtgtattactgtgcgagaggtgatggctacgattccttctactacggtttcgacgtctggggccaagggaccacggtcaccgtctcctca

SEQ ID NO: 4186 - DNA, 333 bp, Homo sapiens
cagtctgtgctgacgcagccgccctcagtgtctggggccccagggcagagggtcaccatctcctgcactgggagcagctccaacatcggggcaggttatgatatacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcggttttcggcggagggaccaagctgaccgtccta

SEQ ID NO: 4187 - DNA, 384 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagcgccaacccaggattactatgatagtagtggttattataggggctggttcgacccctggggccagggaaccctggtcaccgtctcctca

SEQ ID NO: 4188 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcttgatttatgatgtcagtaatcggccctcaggggtttctaatcgcttctctggctccaagtctggcaacacggcctccctgaccatctctgggctccaggctgaggacgaggctgattattactgcagctcatatacaagcagcagctcttatgtcttcggaactgggaccaaggtcaccgtccta

SEQ ID NO: 4189 - DNA, 363 bp, Homo sapiens
gaggtgcagttggtggagtctggaggaggcttgatccagccgggggggtccctgagactctcctgtgcagcctctgggttcaccgtcaatgatcactacatgtactgggtccgccaggctccagggaaggggctggagtgggtctcaattatttatagcggtggcagcacatactacgcagactccgtgaagggccgattcaccatctccagagacaattccaagaacacgctgtatcttcaaatgaacggcctgagagccgaggacacggccgtgtattactgtgcgagagacccttattgtagtggtataagttgctcgggtgactactggggccagggaaccctggtcaccgtctcctca

SEQ ID NO: 4190 - DNA, 321 bp, Homo sapiens
gacatccagatgacccagtctccatcctccctgtctgcatctgtaggagacagagtcaccatcacttgccaggcgagtcaggacattagcaactatttaaattggtatcaccagaaaccagggaaagcccctaaactcctgatctacgatgcatccaatttgaaaacaggggtcccatcaaggttcagtggaagtggatctgggacagattttactttcaccatcagcagcctgcagcctgaagatattgcaacatattactgtcaacagaatcatcatcccccgtacacttttggccaggggaccaagctggagatcaga

SEQ ID NO: 4191 - DNA, 363 bp, Homo sapiens
caggtgcagctggtggagtctgggggaggcgtggtccagcctgggaggtccctgagactctcctgtgcagcctctggattcaccttcagtacccatgctatgcactgggtccgccaggctccaggcaaggggctggagtgggtggcacttatatcatatgatggaaataataaatactacacagactccgtgaagggccgcttcaccatctccagagacaattccaagaacacgctgtatctgcaaatgaacagcctgagagctgaggacacggctgtgtattattgtgcgagaggaacggggggaggctactactacggtatggacgtctggggccaagggaccgcggtcaccgtctcctca

SEQ ID NO: 4192 - DNA, 321 bp, Homo sapiens
gacatccagatgacgcagtctccatcctccctgtctgcatctgtaggagacagagtcaccatcacttgccgggcaagtcagaccattagcagctatttaaattggtatcagcagaaaccagggaaagcccctaagctcctgatctatgctgcatccagtttgcaaagtggggtcccatcaaggttcagtggcagtggatctgggacaggtttcactctcaccatcagcagtctgcaacctgaagattgtgcaatttactattgtcaacagagttacagttcccctcagacgttcggccaagggaccaaggtggaaatcaaa

SEQ ID NO: 4193 - DNA, 354 bp, Homo sapiens
gaggtgcagctggtggagtctgggggaggcttggtaaagcctggggggtcccttagactctcctgtgcagcctctggattcactttcagtaacgcctggatgagttgggtccgccaggctccagggaaggggctggagtgggttggccatattgaaagcaaaactgatggtgggacaacagactacgctgcacccgtgaaaggcagattcaccatctccagagacgattcaaaaaacacgctgtatctccaaatgaacagcctgaaaaccgaggacacagccctttattactgtacccgcggacccttctactttgacttctggggccagggaaccctggtcaccgtctcctct

SEQ ID NO: 4194 - DNA, 321 bp, Homo sapiens
gacatccagatgacccagtctccttccaccctgtctgcatctgcaggagacagagtcaccatcgcctgccgggccagtcagagtattagttcctggttggcctggtatcagcagaaaccagggcaagcccctaaactcctgatctataaggcgtctagtttaaaaagtggggtcccatcaaggttcagcggcagtggatctgggacagaattcactctcaccatcagcagcctgcagcctggtgattttgcaacttattactgccaacagtataataattacccgtggacgttcggccaagggaccaaggtggcaatcaaa

SEQ ID NO: 4195 - DNA, 375 bp, Homo sapiens
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacctctaagaaccagttctccctgaagctgagctctgtgactgccgcggacacggccgtgtattactgtgcgagagccgtatatagtgtctacgatcagctcctcaacggtatggacgtctggggccaagggaccacggtcaccgtctcctca

SEQ ID NO: 4196 - DNA, 321 bp, Homo sapiens
gacatccagttgacccagtctccatccttcctgtctgcatctgtaggagacagagtcaccatcacttgccgggccagtgaggacattagcagttatttagcctggtatcagcacaaaccagggaaagcccctaaactcctgatctatgctgcatccgctttgcaaagtggggtcccatcaaggttcagcggcagtggctctgggacagaattcactctcacaatcagcagcctgcagcctgaagattttgcagcttattactgtcaacagcttcatagttaccctcttactttcggccctgggaccaaagtggatatcaaa

SEQ ID NO: 4197 - DNA, 363 bp, Homo sapiens
caggtccaacttgtgcagtctggggctgaagtgcagaagcctggggcctcagtgagggtttcctgcaaggcttctggattcaccttcactaataatcctatacattgggtgcgccaggcccccggacaaaggcttgagtggatgggatggatcaccgctggcactgattacacaaaatattcacagaacttccagggcagagtcacctttaccagtgacacatccgcgagcacagtgtacatggacctgaacaacttaaaatctgacgacacggctgtgtattattgtgtgagaggtggtagggctggcaacaaccctccctttgaccactggggccggggaaccctggtcaccgtctcctca

SEQ ID NO: 4198 - DNA, 324 bp, Homo sapiens
gaaattgtgttgacgcagtctccaggcaccctgtctttgtctccaggggaaagagtcaccctctcctgcagggccagtcagagtgttagcaacaacgccttagcctggttccagcagagacctggccaggctcccaggctcctcatatatggtgcatccaacagggccactggcatcccagacaggttcagtggaagtgcgtctgggacagacttcactctcaccatcagcagactggaacctgaagattttgcagtgtattactgtcagcagtatggttcctcaccgttcactttcggcggaggggccaaggttgagatcaaa

SEQ ID NO: 4199 - DNA, 375 bp, Homo sapiens
caactgcagctgcaggagtcgggcccaggactggtgaggccttcggagaccctgtccctcacctgcactgtctctggtggctccatcagcagtagtagttactactcgggctggatccgccagcccccagggaaggggctggagtggattggtaatatctattatggtgggagcacctactacaacccgtccctcaagagtcgagtcaccatatccgtagacacgtccaagaaccagttctccctgaaactgagctctgtgaccgccgcagacacggctgtgtattactgtgcgacggaggccattactatgatggtactggctcatcatgcttttgatatctggggccaagggacaacggtcaccgtctcttca

SEQ ID NO: 4200 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagtccccaaactcatgatttatgaggtcagtaatcggccctcaggggtttctaatcgcttctctggctccaagtctggcaacacggcctccctgaccatctctgggctccagactgaggacgaggctgattattactgcagctcatatacaagcatcagcacttatgtcttcggaactgggaccaaggtcaccgtccta

SEQ ID NO: 4201 - DNA, 363 bp, Homo sapiens
caggtgcagctggtggagtctgggggaggcgtggtccagcctgggaggtccctgagactctcctgtgcagcctctggattcaccttcagtacctatgctctgtactgggtccgccaggctccaggcaaggggctggagtgggtggcagttatatcatatgatggaaataataaatactacgcagactccgtgaggggccgattcgccgtctccagagacaattccaagaacacgctgtatctgcaaatgaacagcctgagaactgaggacacggctgtgtattactgtgcgagaccccttagtgggagctacttgagctactttgactactggggccagggaaccctggtcaccgtctcctca

SEQ ID NO: 4202 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacaccaatcggccctcaggggtcactgaccgattctctggctccaagtctggcacctcagcctccctggccatcactgggctccaggctgaggatgaggctgattattactgtcagtcctatgacagcaacctgagtggccccgtattcggcggagggaccaagctgaccgtccta

SEQ ID NO: 4203 - DNA, 381 bp, Homo sapiens
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggctcgggggcagcagccgaaaccccgcattactactactactacggtatggacgtctggggccaagggaccacggtcaccgtctcctca

SEQ ID NO: 4204 - DNA, 324 bp, Homo sapiens; identical to SEQ ID NO: 98

SEQ ID NO: 4205 - DNA, 378 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctattatagtgggagcacctactacaacccgtccctcaagagtcgagtcaccatatccgtagacacgtccaagaaccagttctccctgaagctgagttctgtgaccgcctcagacacggctgtgtattactgtgcgagcacgaacccgccctccctatggttcggggagtcacatgcttttgatatctggggccaagggacaatggtcaccgtctcttca

SEQ ID NO: 4206 - DNA, 330 bp, Homo sapiens; identical to SEQ ID NO: 1600

SEQ ID NO: 4207 - DNA, 336 bp, Homo sapiens
caggtgcagctgcaggagtcgggcccaggactggtgaagccttcggagaccctgtccctcacctgcactgtctctggtgactccatcagtagttattattggagctggttccggcagcccccagggaagggactggagtggattgggtatatctattacagtgggcgcaccaactacaacccctccctccagagtcgagtcaccatttcagtagacacgtccaagaaccagttctccctgaagctgagctctgtgaccgctgcggacacggccgtgtattactgtgcgagagatttctcctcctggggccagggaaccctggtcatcgtctcctca

SEQ ID NO: 4208 - DNA, 324 bp, Homo sapiens
gaaattgtgttgacgcagtctccaggcaccctgtctttgtctccaggagaaagagccaccctctcctgcagggccagtcagagtgttagcaacatctacttagcctggtaccagcagaaacctggccaggctcccaggctcctcatctatggtgcatccagcagggccattggcatcccagacaggttcagtggcagtgggtctgggacagacttcactctcaccatcagcagactggagcctgaagattttgcagtgtattactgtcagcagtatggtagctcaccctggacgttcggccaagggaccaaggtggaaatcaaa

SEQ ID NO: 4209 - DNA, 357 bp, Homo sapiens
gaggtgcagctggtggagtctggaggaggcttgatccagcctggggggtccctgagactctcctgtgcagcctctggggtcaccgtcagaagcaactacatgagctgggtccgccaggctccagggaaggggctggagtgggtctcagttatttatagcggtggtagcaccttctatgcagactccgtgaagggccgattcaccatctccagagacaattccaagaacacgctgtatcttcaaatgaacagcctgagaggcgaggacacggccgtgtattattgtgtgagagccgaggcttggggttcgggcgctttcgacccctggggccagggaaccctggtcaccgtctcctca

SEQ ID NO: 4210 - DNA, 309 bp, Homo sapiens
gacatccagttgacccagtctccatccttcctgtctgcatctgtaggagacagagtcaccatcacttgccgggccagtcagggcattagtagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacaccttaattttttcggcggagggaccaaactggagatcaaa

SEQ ID NO: 4211 - DNA, 393 bp, Homo sapiens
caggtgcagctgatggagtctgggggaggcgtggtccagcctgggaggtccctgagactctcctgtgcagcctctggattcaccttcaatacctatgctatgcactgggtccgccaggctccaggcaaggggctggagtgggtggcagttatatcaaatgatggaagcgatatatactacgcagactccgtgaagggccgattcaccatctccagagacaattccaagaacacgctgtatctgcaaatgaacagcctgagagctgaggacacggctgtgtattactgtgcgagagatcggcagtattacgatactttgactgattattacgttccaacgtcggaataccactttgactactggggccagggaaccctggtcaccgtctcctca

SEQ ID NO: 4212 - DNA, 321 bp, Homo sapiens
gacatccagatgacccagtctccatcttccgtgtctgcagttgtaggagacagagtcaccatcacctgtcgggcgagtcagggtattagcagctggttagcctggtatcagcagaaaccagggacagcccctaagctcctgatctatgctgcatccaatttgcaaagtggggtcccatcaaggttcagcggcagtggatctgggacagatttcactctcaccatcaccagcctgcagcctgaagattttgcaacttactattgtcaacaggctcacagtttccctccgactttcggcggagggaccaaggtggagatcaaa

SEQ ID NO: 4213 - DNA, 384 bp, Homo sapiens
gaggtccacctgttacagtctggggctgaggtgaagaagcctgggaccacagtgaaaatctcctgcaaggtttctggatacattttcaccgactactacatacactggatacaacaggcccctggaaaaggccttgagtgggttggacttattgatcctgaagatgatcaaacaatatatgcagacaagttcaagggcagagtcgtcatttccgcggacacgtctacagacacagccttcatggagctgagcagcctgacatctgacgacacggccgtctattactgtgtgtcacttatttcgggagtcgtcactcgggcccaaggaggtcagggacagaactttgactactggggccagggaaccctggtcagcgtctcctca

SEQ ID NO: 4214 - DNA, 327 bp, Homo sapiens
gacttcaagatgacccagtctccttccaccctgtctgcatctgtgggagacagagtcaccatcacttgccgggccagtcagagtattgataactggttggcctggtatcaacagaaaccagggaaagcccctaaggtcctgatccacatggcgtctagtttacaaagtggggtcccgtcaaggttcagcggcagtggatctgggacagaattcactctcaccatcagcagactgcagcctgatgattttgcgacttattactgcctacaatacaccgtggggtggggggggtggacgttcggcgcagggaccaaggtggaaatcaaa

SEQ ID NO: 4215 - DNA, 369 bp, Homo sapiens
gaggtgcagctgttggagtctgggggaggcttggtacagcctggggggtccctgagactctcctgtgtagcctctgaattcaggtttagtgactatgccatgacatgggtccgccaggctccaggaaagggcctggagtgggtctcagctatttttggcagtggcagtggcagatattatggagactccgtgaagggccgattcaccgtttccagagataattccaagaacacactgtatctgcaaatgaacagcctgagagccgacgacacggccgtatattactgtgcgaaattagggggggcgcaacacctgatctactggcacttcgatctctggggccggggcaccccggtcactgtctcttca

SEQ ID NO: 4216 - DNA, 327 bp, Homo sapiens
gaaatagtgttgacacagtctccagtcaccctgtctttgtctccgggggaaagagccaccctctcctgccgggccagtcagagtattggcacctccttagcctggtaccaacacagagctggccaggctcccaggctcctcatctatgatgcattcaacagggccattggcatcccagccaggttcagtggcagtgggtctgggacagacttcactctcaccatcagcagcctggagcctgaagattttgcagtttattactgtcagcagcgtgacaactggcctccggaggtcactttcggcggagggaccaaggtggagatcaag

SEQ ID NO: 4217 - DNA, 369 bp, Homo sapiens
cagctgcagctgcaggagtcgggcccaggactggtgaagccttcggagaccctgtccctcacctgcactgtctctggtggctccatcagcagtagtaattactactggggctggatccgccagcccccagggaaggggctggagtggattgggagtatctattatagtgggagcacctactacaacccgtccctcaagagtcgagtcaccatatcagtagacacgtccaagaaccagttctccctgaagctgagctctgtgaccgccgcggacacggccgtgtattactgtgcgagagatcaggctacagctacggatctggacggtatggacgtctggggccaagggaccacggtcaccgtctcctca

SEQ ID NO: 4218 - DNA, 324 bp, Homo sapiens; identical to SEQ ID NO: 98

SEQ ID NO: 4219 - DNA, 345 bp, Homo sapiens
caggtgcagctggtgcagtctggggctgaggtgaagaagcctggggcctcaatgaaggtctcctgcaaggcttctggatacaccttcaccggctactatatgtactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagaacgtttccttgactactggggccagggaaccctggtcaccgtctcctca

SEQ ID NO: 4220 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaacctcctgatgtatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaa

SEQ ID NO: 4221 - DNA, 378 bp, Homo sapiens
caggtgcagctggtgcagtctggggctgaggtgaagaagcctggggcctcagtgaaggtttcctgcaaggcatctggatacaccttcaccagtaactatatgcactgggtgcgacaggcccctggacaagggcttgagtggatggggataatcaaccctagtggtggtagcacaagctacgcacagaagttccagggcagagtcaccatgaccagggacacgtccacgagcacagtctacatggagctgagcagcctgagatctgaggacacggccgtttattactgtgcgagagatctgactacggtgactacgatttacgactactactacggtatggacgtctggggccaagggaccacggtcaccgtctcctca

SEQ ID NO: 4222 - DNA, 324 bp, Homo sapiens
tcctatgagctgacacagccaccctcggtgtcagtgtccccaggccagacggccaggatcacctgctctggagatgcattgccaaagcaatatgcttattggtaccagcagaagccaggccaggcccctgtggtggtgacatataaagacagtgagaggccctcagggatccctgagcgattctctggctccagctcagggacaacagtcacgttgaccatcagtggagtccaggcagaagacgaggctgactattactgtcaatcagcagacagcagtggtagttatgtggtattcggcggagggaccaagctgaccgtccta

SEQ ID NO: 4223 - DNA, 384 bp, Homo sapiens
caggtccagttggtgcagtctggggctgaggtgaagaagccgggggcctcagtgaaggtctcctgcaaggtttccgaatacaccctcactgaattatccatccactgggtgcgacaggctcctggaaaagggcttgagtggatgggaggttttgatcctgaagagggtgaaacaatctacgctcagaaattccagggcagagtcaccatgaccgaggacacatctacagatacagcctacatggagctgagcagcctgagatctgaggacacggccgtgtattactgtgcaacgtctggttggtataattgtagtagtaccatctgctatggagcaaagtggttcgacccctggggccagggaacactggtcaccgtctcctca

SEQ ID NO: 4224 - DNA, 330 bp, Homo sapiens
cagtctgtgttgacgcagccgccctcagtgtctgcggccccaggacagcaggtcaccatctcctgctctggaagcagctccaatattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagcctgagtgctgtgatcttcggaactgggaccaaggtcaccgtccta

SEQ ID NO: 4225 - DNA, 336 bp, Homo sapiens
caggtgcagctgcaggagtcgggcccaggactggtgaagccttcggagaccctgtccctcacctgcactgtctctggtgactccatcagtggttattactggagctggatccggcagcccccagggaagggactggagtggattggatatatatattacagtgggagaaccgactacaacccctccctcaagagtcgagtcaccatttcaggagacacgtccaagaatcagttgtccctgaagttgaactctgtgaccgctgcggacacggccgtctattactgtgcgagagggttcgactcctggggccagggaaccctggtcaccgtctcctca

SEQ ID NO: 4226 - DNA, 324 bp, Homo sapiens
gaaattgtgttgacgcagtctccaggcaccctgtctttgtctccaggggaaagagccaccctctcctgcagggccagtcagagtgttagcagcatctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatttctgtcagcagtatggttcctcaccgtggacgttcggccaagggaccaaggtggaaatcaaa

SEQ ID NO: 4227 - DNA, 363 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcctttattggagtgacgataagcgctacagcccatctctgaagaccagactcaccatcacccaggacacctccaaaaaccaggtggtccttacaatgaccaacgtggaccctgtggacacagccacgtatttctgtgcacaggtagtggttattacgggcgatgcttttgatatctggggccaagggacaatggtcaccgtctcttca

SEQ ID NO: 4228 - DNA, 321 bp, Homo sapiens
tcctatgagctgacacagccaccctcggtgtcagtgtccccaggacagacggccaggatcacctgctctggagatacattgccaaagcaatatgtttattggtatcagcagaagccaggccaggcccctgtgttggttatatataaagacagtgagaggccctcagggatccctgagcgattctctggctccagctcagggacgaaagtcacgttgaccatcattggagtccaggcagaagacgaggctgactattactgtcaatcagcagacagcagtggaacttatgtcttcggagctgggaccaaggtcaccgtccta

SEQ ID NO: 4229 - DNA, 390 bp, Homo sapiens
caggtgcaactggtgcagtctggggctgaggtgaagaagcctgggtcctcggtgaaggtctcctgcaaggcttctggaggcaccttcagcacctatgctatcagctgggtgcgacaggcccctggacaagggcctgagtggatgggaaggatcatccctatgtatgatagagcacacatcgcacagaagttccagggcagagtcacgattacagcggacatctccacgagcacagcctacatggagctgagcagcctgagatctgaggacacggccgtgtattactgtgcgagagtgacaggatattgtagtactaccagttgctatggggggtaccactacaacggcatggacgtctggggccaagggaccacggtcaccgtctcctca

SEQ ID NO: 4230 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcactttcggcggagggaccaaggtagagatcaaa

SEQ ID NO: 4231 - DNA, 375 bp, Homo sapiens
gaggtgcagctggtggagtctgggggaggcttggtccagcctggggggtccctgagactctcctgtgcagcctctggattcacccttagtagctattggatgacctgggtccgccaggctccagggacggggctggagtgggtggccaacataaaccaagatggaagtgaggaatactatgtagactctgtgaggggccgattcaccatctccagagacaacgccaagaactcactgtatctgcaaatgaacagcctgagagccgaggacacggctgtgtattactgtgcgagagaaaattgtggtggtgactgctattccccaagtttcggtatggacgtctggggccaagggaccacggtcaccgtctcctca

SEQ ID NO: 4232 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtctaatacttacccgatcactttcggcggagggaccaaggtggagatcaaa

SEQ ID NO: 4233 - DNA, 390 bp, Homo sapiens
caggtgctactggtgcagtctggggctgaggtgaagaagcctggggcctcagtgaaggtctcctgcaaggcttctggatacactttcaccggccactatatacactgggtgcgacaggcccctggacaagggcttgagtggatgggatggatcaaccctatcagtggtggcacaaattatgcacagaagtttcagggcagggtcaccatgaccagggacacgtccatcagcacagcctacatggagctgagcaggctgagatctgacgacacggccgtgtattactgtgcgagagaggggcttttctcgggaggtggagctcgcggacttactgactactactacggtttggacgtctggggccaagggaccacggtcaccgtcacctca

SEQ ID NO: 4234 - DNA, 345 bp, Homo sapiens
gacatcgtgatgacccagtctccagactccctggctgtgtctctgggcgagagggccaccatcaactgcaagtccagccagagtgttttatacagctccaacaataagaattacttagcttggtatcagcagaaaccaggacagcctcctaagctgctcatttactgggcatctacccgggaatccggggtccctgaccgattcagtggcagcgggtctgggacagatttcactctcaccatcagcagcctgcaggcagaagatgttgcagtttattactgtcagcaatatcatagtactcctccaatattcactttcggccctgggaccaaagtggatatcaaa

SEQ ID NO: 4235 - DNA, 351 bp, Homo sapiens
gaggtgcagctggtggagtctgggggaggcttggtccagccgggggggtccctgagactctcctgtgcagcctctggtctcaccgtcagtagcaactacatgagctgggtccgccaggctccagggaaggggctggagtgggtctcaattatttatagcggtggtagcacattctatgtagactccgtgaagggccgattcaccatctccagagacaattccaagaacacgctggatcttcaaatgaacagcctgagagctgaggacacggctgtgtattactgtgcgagagatttgtcggagtacgggatggacgtctggggccaagggaccacggtcaccgtctcctca

SEQ ID NO: 4236 - DNA, 330 bp, Homo sapiens
cagtctgccctgactcagcctccctccgtgtccgggtctcctggacagtcagtcaccatctcctgcactggaaccagcagtgacgttggtagttataatcgtgtctcctggtaccagcagcccccaggcacagcccccaaactcatgatttatgaggtcagtaatcggccctcaggggtccctgatcgcttctctgggtccaagtctggcaacacggcctccctgaccatctctgggctccaggctgaggacgaggctgattattactgcagctcatatacaagcagcagtactttggtattcggcggagggaccaagctgaccgtccta

SEQ ID NO: 4237 - DNA, 375 bp, Homo sapiens
cagctgcagctgcaggagtcgggcccaggactggtgaagccttcggagaccctgtccctcacctgcactgtctctggtggctccatcagcagtagtagttactactggggctgggtccgccagcccccaacgaaggggctggagtggattgggagtatctattatagtgggagcacctactacaacccgtccctcaagagtcgagtcaccatatccgtagacacgtccaggaaccagttctccctgaggctgagctctgtgaccgccgcagacacggctgtgtattactgtgcgacttccatggttcggctagattactataattactacggtatggacgtctggggccaagggaccacggtcaccgtctcctca

SEQ ID NO: 4238 - DNA, 330 bp, Homo sapiens
cagtctgccctgactcaggttgcctccgtgtctgggtctcctggacagtcgatcaccttctcctgcactggaaccagcagtgacgttggtggttataactatgtctcctggtaccaacaacacccaggcaaagcccccaaactcatgatttatgatgtcactaatcggccctcaggggtttctgatcgcttctctggctccaagtctggcaacacggcctccctgaccatctctgggctccagcctgaggacgaggctaattattactgcagctcatatacaaccatcagcacttgggtgttcggcggagggaccaagctgaccgtccta

SEQ ID NO: 4239 - DNA, 351 bp, Homo sapiens; identical to SEQ ID NO: 4235

SEQ ID NO: 4240 - DNA, 321 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcgccagtggatctgggacagatttcactctcactatcagcaacctgcagcctgaagattttgcaacttacttttgtcaacagactaacagtttccctccccacttcggccaagggacacgactggagattaaa

SEQ ID NO: 4241 - DNA, 369 bp, Homo sapiens
gaggtgcagctggtggagtccgggggaggcttagttgagcctggggggtccctgagactctcctgtgcagcctctggattcatcttcagtagggactggatgcactgggtccgccaagctccagggaaggggctggtttgggtctcacgtattgatagtgatgggagtagtacaagttacgcggactccgtgaagggccgattcaccatctccagagacaacgccaagaacacgctgtatctgcaaatgaacaatctgagagccgaggacacggctgtttattactgtgcaagagtggaagccaggtggttaggtggttatttaccctttgactcctggggccagggaaccctggtcaccgtctcctca

SEQ ID NO: 4242 - DNA, 339 bp, Homo sapiens
gacatcgtgatgacccagtctccagactccctggctgtgtctctgggcgagagggccaccatcgactgcaagtccagccagagtgttttatactactccaacaaaaagaactacttagcttggtaccagcagaaaccaggacagcctcctaagctgctcatttactgggcatctacccgggaatccggggtccctgaccgattcagtggcagcgggtctgggacacatttcactctcaccatcagcagcctgcaggctgaagatgtggcagtttattactgtcagcaatattatagtactcctctcactttcggcggagggaccaaggtggagatcaaa

SEQ ID NO: 4243 - DNA, 363 bp, Homo sapiens
gaggtgcagctggtggagtctgggggaggcctggtcaagccgggggggtccctgaggctctcgtgtgcagcctctggattcgctttcactaactatcacatgaactgggtccgccaggctccagggaaggggctggagtgggtctcatccatcagtcgtttcagtagtgacacattctacgcagactcagtgaggggccgattcaccatctccagagacaacgccaagaactcactacatctgcaactggacagcctgagagccgaggacacggctatttattactgtgcgagagatcggagggcagttgctggtactccctttgactactggggccggggaaccctggtcgccgtctcctca

SEQ ID NO: 4244 - DNA, 327 bp, Homo sapiens
tcctatgtgctgactcagccaccctcagtttcagtggccccaggaaagacggccacgattacctgtggggaattgaaggttggaactcaaggtgtgcactggtaccagcagaagccaggccaggcccctgttctgatcatctattatgataacgaccggccctcagatatccctgagcgattctctggctccaactctgggaacacggccaccctgaccatcaacagggtcgaagccggggatgaggccgactatttctgtcacgcgtgggacattagtggtgatctccgtcatgtcttcggaactgggaccaaggtcaccgtccta

SEQ ID NO: 4245 - DNA, 375 bp, Homo sapiens
cagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggaatatctattatagtgggaccacctactacaacccgtccctcaggagtcgagtcaccatatcagtagacacgtccaagaatcagttttccctgaagctgagctctgtgaccgccgcggacacggccgtgtatttctgtgcgaccgagactacggtgactacgcgttattactactatgctatggacgtctggggccaagggaccacggtcaccgtcccctca

SEQ ID NO: 4246 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacagcacccaggcaaagcccccaaagtcatcatttatgaggtcagtaatcggccctcaggggtttctaatcgcttctctgcctccacgtctggcaacacggcctccctgaccatctctgggctccaggctgaggacgaggctgattattactgcagctcatttacaagcatcagcactctcgtcttcggaactgggaccaaggtcaccgtcgta

SEQ ID NO: 4247 - DNA, 360 bp, Homo sapiens
caggtgcaactggtggagtctgggggaggcgtggtccagcctgggaggtccctgagactctcctgtgcagcctctggattcaccttcagtggctatgctatgcactgggtccgccaggctccaggcaaggggctgcagtgggtggcagttatatcatatgatggaatcaataaatactacccagactccgtgaagggccgattcaccatctccagagacaattccaacgacacgctgtatctgcaaatgatcagcctgagaactgaggacacggctgtgtattactgtgcgagagcaaggggtgggagctaccaaccttctgactactggggccagggaaccctggtcaccgtctcctca

SEQ ID NO: 4248 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccaacagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctttattcactttcggccctgggaccaaagtggatatcaaa

SEQ ID NO: 4249 - DNA, 360 bp, Homo sapiens
caggtgcagctggtggagtctgggggaggcgtggtccagcctgggaggtccctgagactctcctgtgcagcctctggattcaccttcagtagctctgctatgcactgggtccgccaggctccaggcagggggctggagtgggtggcagttatatcatatgatggaagtaataaatactatgcagactccgtgaagggccgattcaccatctccagagacaattccgagaacacggtgcatttgcaaatgaatagcctgagagctgaggacacggctgtgtattactgtgcgaaagccctcggaggtggctaccggggaattgactactggggccagggaaccctggtccccgtctcctca

SEQ ID NO: 4250 - DNA, 321 bp, Homo sapiens
gacatccagatgacccagtctccagcctccctgtctgcatctgtaggagacagagtcaccatcacttgccaggcgagtcaggacattagctactatttaagttggtatcagcagaaaccagggaaagcccctcagctcctgatctacgatgcatccaattttgaaactggggtcccatcaaggttcactggaagtgggtctgggacagattttactttcaccatcagcagcctgcagcctgaagatattgcaacatattactgtcaacagtatcataatctacctctcactttcggcggagggaccaaggtggagatcaat

SEQ ID NO: 4251 - DNA, 363 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaagtaataaatactacgcagactccgtgaagggccgattcaccatctccagagacaactccaagaacacgctgtatctgcaaatgaacagcctgagagctgaggacacggctgtgtattactgtgcgaggtcctatagtgggaactacaacaacgcttttcatatgtggggccaagggacaatgctcaccgtctcttca

SEQ ID NO: 4252 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtttggtggctcacctgcgtacacttttggccaggggaccaagctggagatcaaa

SEQ ID NO: 4253 - DNA, 369 bp, Homo sapiens
caggtgcagctgcaggagtcgggcccaggactggtgaagccttcacagaccctgtccctcacgtgcactgtctctggtggctccatcagcagtggtggttactactggagctggatccgccagcacccagggaagggcctggagtggattgggttcatctattacagtgggaacacctaccacaacccgtccctcaagagtcgagttaccatatcaatagacacgtctaagaaccagttctccctgaagctgagctctgtgactgccgcggacacggccgtgtattattgtgcgagtcaattcgggggctatggttcggggagttattatagggactggggccagggaaccctggtcaccgtctcctca

SEQ ID NO: 4254 - DNA, 324 bp, Homo sapiens
gaaattgttttgacacaatctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctggagcctgaagattttgcagtttattactgtcagcagcgtaccaaccggcctccgtacacttttggccaggggaccaagctggatatcaaa

SEQ ID NO: 4255 - DNA, 381 bp, Homo sapiens
caggtgcagctgcaggagtcgggcccaggactggtgaagccttcggagaccctgtccctcacctgcactgtctctggtggctccatcagtagttcctactggagctggatccggcagcccccagggaagggactggagtggattgggtatatctattacagtgggagcaccaagtacaacccctccctcaagagtcgagtcaccatatcagtagacacgtccaagaaccagttctccctgaagctgagctctgtgaccgctgcggacacggccgtgtattattgtgcgagagatcaacccgaaactataaagatttttggagtggttgcatcttccggtatggacgtctggggccaagggaccacggtcaccgtctcctca

SEQ ID NO: 4256 - DNA, 321 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctttggtgcatctaccagggccactggtatcccagccagattcagtggcagtgggtctgggacagagttcactctcaccatcagcagcctgcagtctgaagatttttcagtttattactgtcagcagtataataactggcctttcaccttcggccaagggacacgactggagattaaa

SEQ ID NO: 4257 - DNA, 357 bp, Homo sapiens
gaggtgcacctggtggagtctgggggaggcctggtcaagcctggggggtccctgagactctcctgtgcagcctctggattcaccttcagtagctatagcatgaactgggtccgccaggctccagggaaggggctggagtgggtctcatccattagtagtagtagtagttacatatcctacgcagactcagtgaagggccgattcaccatctccagagacaacgccaaggactcactgtatctgcaaatgaacagcctgagagccgaggacacggctgtgtattactgtgcgagaaggagtgactacggtgaggtccttgactactggggccagggaaccctggtcaccgtctcctca

SEQ ID NO: 4258 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctactcgggaatccggggtccctgaccgattcagtggcagcgggtctgggacagatttcactctcaccatcagcagcctgcaggctgaagatgtggcagtttattactgtcagcaatattatagtcctccgctcactttcggcggcgggaccaaggtggagatcaaa

SEQ ID NO: 4259 - DNA, 390 bp, Homo sapiens
caggtgcagctgcaggagtcgggcccaggactggtgaagccttcacagaccctgtccctcacctgcactgtctctggtggctccatcagcagtggtggttactactggagctgggtccgccagcacccagggaagggcctcgagtggattgggaacatctatcacagtggggggagcacctactacaacccgtccctcaagagtcgagttaccatatctatagacacgtctaagaaccagttctccctgaagctgaactctgtgactgccgcggacacggccatttattactgtgcgagcgagtcgataaatgtggttcggggagtgcctctctactactactacgctatggacgtctggggcctagggaccacggtcaccgtctcctca

SEQ ID NO: 4260 - DNA, 330 bp, Homo sapiens
cagtctgccctgactcagcctgcctccgtgtctgcgtctcctggacagtcgatgaccatctcctgcactggaaccagcagtgacgttggtcgttataactatgtctcctggtaccaacagcacccaggcaaagcccccaaactcttgatttatgatgtcagtaatcggccctcaggggtttctaatcgcttctctggctccaagtctggcaacacggcctccctgaccatctctgggctccaggctgaggacgaggctgattattactgcagctcatttacaagcagcagcacttgggtgttcggcggagggaccaacctggccgtccta

SEQ ID NO: 4261 - DNA, 384 bp, Homo sapiens
gaggtgcagctggtgcagtctggagcagaggtgaaaaaggccggggagtctctgaagatctcctgtaagggttctggatacagttttaccaactactggatcggctgggtgcgccagatgcccgggaaaggcctggagtgcatggggatcatctatcctggtgactctgacaccagatacagcccgtccttccaaggccaggtcaccatctcagtcgacaagtccatcagcaccgcctacctgcagtggagcagcctgaaggcctcggacaccgccatatactcttgtgcaagactgacttctaacagtggctggtactcttcccgccggcacctgagttactttgactactggggccagggaaccctggtcaccgtctcctca

SEQ ID NO: 4262 - DNA, 324 bp, Homo sapiens
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctatgaggacaccaaacgaccctccgggatccctgagagattctctggctccatctcagggacaatggccaccttgactatcagtgggacccaggtggaggatgaagctgactactactgttactcagcagacagcagtgctaatcatagggtgttcggcggagggaccaagctgaccgtccta

SEQ ID NO: 4263 - DNA, 369 bp, Homo sapiens
gaggtggagctggtggagtctgggggaggcctggtcaagcctgggaagtccctgagactctcctgtgcagcctctggattcaccttcagtacctatgccatgaactgggtccgccaggctccagggaaggggctggagtgggtctcatgcattactagtaatagtgacatatactacgcagactcagtgaagggccgattcaccatctccagagacaacgccaagaactcactgtatctgcaaatgaatagcctgagagccgaggacacggctgtctattactgtgcgagggcccgaaggagctacacaaccgttagactgtactactttgactactggggccagggaaccctggtcaccgtctcctca

SEQ ID NO: 4264 - DNA, 324 bp, Homo sapiens
gaaatagtgatgacgcagtctccagccaccctgtctgtgtctccagggggaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattcctgtcagcagtataataactggccttcgtacacttttggccaggggaccaagctggagatcaaa

SEQ ID NO: 4265 - DNA, 363 bp, Homo sapiens
cagatgcagctgcaggagtcgggcccaggactggtgaagccttcggagaccctgtccctcacctgcaatgtctctggtggctccatcaccagttactactggagctggatccggcagcccgccgggaagggactggagtggattgggcgtatctataccagtgggagcaccaactacaacccctccctcaagagtcgagtcaccatgtcagtagacacgtccaagaaccagttctccctgtacctgagctctgtgaccgccgcggacacggccgtctactactgtgcgagagcccaactactcaactactactactacggaatggacgtctggggccaagggaccacggtcaccgtctcctca

SEQ ID NO: 4266 - DNA, 333 bp, Homo sapiens
cagtctgtgctgactcagccaccctcagcgtctgggacccccgggcagagggtcaccatctcttgttctggaagcagctccaatatcggaagtaatattgtaaactggtaccagcagctcccaggaacggcccccaaactcctcatctatagtaataatcagcggccctcaggggtccctgaccgattctttggctccaagtctggcacctcagcctccctggccatcagtgggctccagtctgaggatgaggctgattattactgtgcagcatgggatgacagcctgaatggccgttatgtcttcggaactgggaccaaggtcaccgtccta

SEQ ID NO: 4267 - DNA, 351 bp, Homo sapiens
gaggtgcagctggtggagtctgggggaggcttggtccagcctggggggtccctgagactctcctgtgcagcctctggattcatctttagtacctattggatgacctgggtccgccaggctccagggaaggggctggagtgggtggccaacataaaacacgacggaagtgggaaataccatgtggactctgtgaagggccgattcaccatctccagagacaacgccaagaactcactgtatctgcaaatgaacagcctgagagtcgaggacacggctgtatattactgtacgagagatgaaggtggctggtacgactactggggccagggaaccctggtcatcgtctcctca

SEQ ID NO: 4268 - DNA, 333 bp, Homo sapiens
cagtctgccctgactcagcctgcctccgtgtctgggtctcctggacagtcgatcaccatctcctgcactggaaccagcagtgatgttgggagttataaccctgtctcctggtaccaacaacacccaggcaaagcccccaaagtcatgatttatgagggcagtaagcggccctcaggggtttctaatcgcttctctggctccaagtctggcaacacggcctccctgacaatctctgggctccaggctgaggacgaggctgattattactgctgctcatatgcacgtagtagcactttcatggtcttcggcggagggaccaagctgaccgtccta

SEQ ID NO: 4269 - DNA, 360 bp, Homo sapiens
caggtgcagctggtggagtctgggggaggcgtggtccagcctgggaggtccctgagactctcctgtgcagcgtctggattcaccttcagcaattatggcatgcactgggtccgccaggctccaggcaaggggctggagtgggtggcagttatatggtatgatggaagtaaaaaatactatgtagacgccgtgaagggccgattcaccatctccagagacaattccaagaacacgctgtatctgcaaatgaatagcctgagagccgaggacacggctatatattactgtgcgacagatgtcccgttcggtgactcccctctggacgtctggggccaagggaccacggtcaccgtctcctca

SEQ ID NO: 4270 - DNA, 324 bp, Homo sapiens
tcctatgagctgacacagccaccctcggtgtcagtgtccccaggacaaacggccaggatcacctgctctggagatgccttgccaaaaaaatatgcttattggtaccagcagaggtcaggccaggcccctgtgctggtcatctatgaggacagcaaacgaccctccgggatccctgagagattctctggctccagctcagggacaatggccaccttgactatcagtggggcccaggtggaggatgaagctgactactactgttactcaacaggcagcagtggtaatcattatgtcttcggaactgggaccaaggtcaccgtccta

SEQ ID NO: 4271 - DNA, 351 bp, Homo sapiens
gaggtgcagttggtggagtctgggggaggcttggtccagcctggggggtccctgagactctcctgtgcagcctcgggaatcatcgtcagtagcaactacatgagctgggtccgccaggctccagggaaggggctggagtgggtctctcttctttatagcggtggtagtacattctacgcagactccgtgaggggccgattcaccatctccagagacaattccaagaacacgctgtatcttcaaatgaacttcctgagagctgacgacacggctgtgtattactgtgcgagagatctcgccgactacggtatggacgtctggggccaagggaccacggtcaccgtctcctca

SEQ ID NO: 4272 - DNA, 324 bp, Homo sapiens
gacatccagttgacccagtctccatccttcctgtctgcatctgtaggagacagagtcaccatcgcttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagacttcactctcacaatcagcagcctgcagcctgaagattttgcaacttattactgtcaacagcttaatacttcccctccgatcaccttcggccaagggacacgactggagatgaaa

SEQ ID NO: 4273 - DNA, 363 bp, Homo sapiens
caggtgcagctgcaggagtcgggcccaggactggtgaagccttcacagaccctgtccctcacctgcactgtctctggtggctccatcagcagtggtacttactactggagctggatccggcagcccgccgggaagggactggagtggattgggcgtatttataccactgggagcaccgactacaacccctccctcaagagtcgagtcaccatatcagtagacacgtccaagaaccagttctccctgaagctgaactctgtgaccgccgcagacacggccgtgtattactgtgcgagcgatcttggaccagcagctggatactttgactactggggccagggaaccctggtcaccgtctcctca

SEQ ID NO: 4274 - DNA, 318 bp, Homo sapiens
tcctatgagctgactcagccaccctcagtgtccgtgtccccaggacagacagccagcatcacctgctctggagataaattgggggataaatattcttgctggtatcagcagaagccaggccagtcccctgtgttggtcatctatcaagataccaagcggccctcagggatccctgagcgattctctggctccaactctgggaacacagccactctgaccatcagcgggacccaggctatggatgaggctgactattactgtcaggcgtgggacaggaccactgtggtattcggcggagggaccaagctgaccgtccta

SEQ ID NO: 4275 - DNA, 354 bp, Homo sapiens
cagatcaccttgaaggagtctggtcctacgctggtgaaacccacacagaccctcacgctgacctgcaccttctcagggttctcactcagcactagtggagtgagtgtgggctggatccgtcagcccccaggaaaggccctggagtggctcgcactcatttattgggatgatgataagcgctacagcccatctctgaagagcaggctcgccatcaccaaggacacctccaaaaaccaggtggtcctgacaatgaccaacatggaccctgtggacacagccacatattactgtgcacactcaacaccccaattcattgactactggggccagggaaccctggtcaccgtctcctca

SEQ ID NO: 4276 - DNA, 315 bp, Homo sapiens
tcctatgagctgactcagccaccctcagtgtccgtgtccccaggacagacagccagcatcacctgctctggagataaattgggggatcaatatgtttgctggtatcagcagaagccaggccagtcccctgtgccggtcatctatcaagataacaagcggccctcagggatccctgagcgattctctggctccaactctgggaacacagccactctgaccatcagcgggacccaggctatggatgaggctgactattactgtcaggcgtgggacagtagccttgtattcggcggagggaccaagctgaccgtccta

SEQ ID NO: 4277 - DNA, 375 bp, Homo sapiens
caggtgcaactggtggagtctgggggaggcgtggtccagcctgggaggtccctgagactctcctgtgcagcctctggattcaccttcagtaactatgctatgcactgggtccgccaggctccaggcaaggggctggagtgggtggcagctatatcatatgatggaactaataaatactacgcagactctgtgaagggccgattcaccatctccagagacaattccaagaacacgctgtatctgcaaatgaacagcctgagagctgaggacacggctgtgtattactgtgcgagagataacaccgggtgggttcggggagttattgagcggtacttcgatctctggggccgtggcaccctggtcactgtctcctca

SEQ ID NO: 4278 - DNA, 321 bp, Homo sapiens
gaaattgtgttgacacagtctccagccaccctgtctttgtctccaggggaaagagccaccctctcctgcagggccagtcagagtgttttcagctacttagcctggtaccaacaaaaacctggccaggctcccaggctcctcatctatgatgcatccgacagggccactggcatcccagccaggttcagtggcagtgggtctgggacagacttcactctcaccattagtagcctagagcctgaagattttgcagtttattactgtcagcagcgtagcaactggcccctcactttcggcggagggaccaaggtggagatcaaa

SEQ ID NO: 4279 - DNA, 363 bp, Homo sapiens
gaagtgcagctggtggagtctgggggaggcttggtacagcctggcaggtccctgagactctcctgtgcagcctccggattcatctttgatgattatgtcatgcactgggtccggcaagctccagggaagggcctggagtgggtctcaggtattaattggaatagtggtaatataggctatgcggactctgtgaggggccgattcaccatctccagagacaacgccaagaactccctgtatctgcaaatgaacagtctgagagctgaggacacggccttgtattactgtgcaaaagataaagtgttcagtggctggggcgcttttgatatctggggccaagggacaatggtcaccgtctcttca

SEQ ID NO: 4280 - DNA, 321 bp, Homo sapiens
gacatccagatgacccagtctccttccaccctgtctgcatctgtaggagacagagtcaccatcacttgccgggccagtcagagtattcgtagctggttggcctggtatcagcagaaaccaggaaaagccccgaagctcctgatctataaggcgtctagtttagaaagtggggtcccatcaaggttcagcggcagtggatctgggacagaattcactctcaccatcagcagcctgcaggctgatgattttgcaacctattactgccaacagtataatagttttccctggacgttcggccaagggaccaaggtggaaatcaaa

SEQ ID NO: 4281 - DNA, 372 bp, Homo sapiens; identical to SEQ ID NO: 1441

SEQ ID NO: 4282 - DNA, 324 bp, Homo sapiens; identical to SEQ ID NO: 352

SEQ ID NO: 4283 - DNA, 384 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcacttatatactatgatggaagtaatacatactatgcagattccgtgaagggccgattcaccatctccagagacaataccaagaacactctgtatctgcaaatgaacagcctgagcgccgaagacacggctatatattactgtgcgagagatcggtcggacgaatatgatagtagtggctattcctatggggggacctttgactactggggccagggaaccctggtcaccgtctcctca

SEQ ID NO: 4284 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctaatttagaaagtggggtcccatcaaggttcagcggcagtggatctgggacagaattcactctcaccatcagcagcctgcagcctgatgattttgcaacttattactgccaacagtatagtagttattcaaatacgttcggccaagggaccaaggtggaaatcaaa

SEQ ID NO: 4285 - DNA, 354 bp, Homo sapiens
gaggtgcaactggtggagtctggaggaggcttgatccagcctggggggtccctgagactctcctgtgcagcctctgggttaaccgtcagtagcaactacatgacctgggtccgccaggctccagggaaggggctggagtggatctcaattatttatagcggtggtagtacattctacgcagactccgtgaagggccgattcaccatctccagagacaattccaagaacacgctgtttcttcaaatgtacagcctgagagccgaggacacggccatatattactgtgcgagaaatctggacgtcgcgggtgcttttgatatctggggccaagggacagtggtcaccgtctcttca

SEQ ID NO: 4286 - DNA, 318 bp, Homo sapiens
gaaattgtgctgacgcagtctccaggcaccctgtctttgtctccaggggaaagagccaccctctcctgcagggccagtcagagtattagcagtagctacttagcctggtaccagcagaaacctggccaggctcccaggctcctcatctatggtgcatccagcagggccactggcatcccagacaggttcagtggcagtgggtctgggacagacttcactctcaccatcagcaggctggagcctgaagattctgcagtgtattactgtcagcagtatgatacgtggacgttcggccaggggaccaaggtggaaatcaaa

SEQ ID NO: 4287 - DNA, 366 bp, Homo sapiens
caggttcagctggtgcagtctggagctgaggtgaagaagcctggggcctcagtgaaggtctcctgcaaggcttctggttacacctttaccagctatggtatcagctggatgcgacaggcccctggacaagggcttgagtggatgggatggatcagctcttacaatggtaacacaaactatgcacagaagttccagggcagactcaccatgaccacagacacatccacgagcacagcctacatgcagctgaggagcctgagatctgacgacacggccgtgtattactgtgcgagagatacggcgcagctttggttaaaacaaccctttgactactggggccagggaaccctggtcaccgtctcctca

SEQ ID NO: 4288 - DNA, 336 bp, Homo sapiens
gatattgtaatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcaggagagtggaggctgaggatgttggggtttattactgcatgcaagctctacaaactcttcgcactttcggcggagggaccaaggtggagatcaaa

SEQ ID NO: 4289 - DNA, 360 bp, Homo sapiens
cagatcaccttgagggagtctggccctacactgcttaaacccacagagaccctcacgctgacctgcaccttctctgggttctccctcagcaccagtggagtcagtgtgggctggttccgtcagtccccaggcaaggccctggagtggctgactctcgtttattggagtgataataagcgctacagtccatctctgatgagcaggctcaacatcaccaaggacacctccaaaaaccaggttgtcctgacgatgacaaacatggaccctgtggacacaggcacatatttttgtgcacacagccgtattgcggcagctgggttcgacccctggggccaaggaaccctggtcatcgtctcctca

SEQ ID NO: 4290 - DNA, 321 bp, Homo sapiens
gacatccagttgacccagtctccgtcctccctgtctgcatctgtgacagacagagtcaccatcacttgccgggcaaatcagaccattttcgtctacctaaattggtatcagcagaaagtagggaaagccccaaaactcctgatctatgctgcatccgaattgcaaagtggggtttcatcacggttcagtggccgtggctctgggacagaattcactctcaccatcagcagtctgcaacctgatgatttcgcaacttactactgtcagcagggttacagagccccgtatacctttggtcaggggaccgacctgcggatcaaa

SEQ ID NO: 4291 - DNA, 369 bp, Homo sapiens
cagctgcagctgcaggagtcgggcccaggaatggtgaagccttcggagaccctgtccctcacctgcactgtctcgggtggctccatcagcagtaatacttactactggggctggatccgccagcccccagggaaggggctggaatggattgggaatatgtattatagtgggaccacctactacaacccgtccctcaagagtcgagtcaccatatcagtagacacgtccaagaaccagttctccctgaagctgaactctgtgaccgccgcggacacggccgtgtattactgtgcgagagatcacgatattttgactggttatgatgctcttgatatctggggccaagggacaatggtcaccgtctcttca

SEQ ID NO: 4292 - DNA, 321 bp, Homo sapiens
gacatccagatgacccagtctccatcctccctgtctgcatctgtaggagacagagtcaccatcacttgtcgggcaagtcagggcattagaaatgatttaggctggtatcagcagaaaccagggaaagcccctaagcgcctgatctatgctgcatccagtttgcaaagtggggtcccatcaaggttcagcggcagtgggtctgggacagaattcactctcacaatcagcagcctgcagcctgaagattttgcaacttattactgtctacagcataatacttaccctctcactttcggcggagggaccaaggtggagatcaaa

SEQ ID NO: 4293 - DNA, 360 bp, Homo sapiens
cagctgcagctgcaggagtcgggcccaggactggtgaagccttcggagaccctgtccctcacgtgcactgtctctggtgactccatcagcagtagtagttactactggggctggatccggcagcccccagggaagggactggaatggattgggagtatctatcatattgggaccacctacgacaacccgtccctcaagagtcgagtcaccatatcagtagacacgtccaagaaccagttctccctgaagctgatctctgtgaccgccgcggacacggccgtgtattactgtgcgagaccacttacggtgactatgccctttgcctactggggccagggaatcctggtcaccgtctcctca

SEQ ID NO: 4294 - DNA, 318 bp, Homo sapiens
gacatccagatgacccagtctccttccaccctgtctgcatctgtaggagagagagtcaccatcacttgccgggccagtcagagtattgataagtggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttattactgccaacagtataatagttattccacttttggccaggggaccaagctggagatcaaa

SEQ ID NO: 4295 - DNA, 363 bp, Homo sapiens
cagatcaccttgaaggagtctggtcctacgctggtgaaacccacacagaccctcaccctgacctgcaccttctctgggttctcactcagcacgagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgtacacaggggggggatgttgtactatttttttgactactggggccagggaaccctggtcaccgtctcctca

SEQ ID NO: 4296 - DNA, 321 bp, Homo sapiens
gacatccagatgacccagtttccatcctccctgtctgcatctgtaggagacagagtcaccatcacttgtcggacaagtcagagcattggcagctttttaaattggtatcagcagaaaccagggaaagcccctaagctcctgatctctgctgcatccagtttgcaaagtggggtcccatcaaggttcagtggcggtggatctgggacagatttcactctcaccatcagcagtctacaacctgaagattttgcaacttactactgtcaacagagttacagtaccccgtggacgttcggccaagggaccaaaatggaaatcaaa

SEQ ID NO: 4297 - DNA, 363 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggcggcaattatatcatatgatggaattaataaatactacgcagactccgtgaggggccgattcaccatctccagagacaattccaagaacacgctgtatctgcaaatgaacagcctgagacctgaggacacggctgtcttttactgtgcgagagcgactagtgggagctactaccggagtatggacgtctggggccaagggaccacggtcaccgtctcctca

SEQ ID NO: 4298 - DNA, 333 bp, Homo sapiens
cagtctgccctgactcagcctgcctccgtgtctgggtctcctggacagtcgatcaccatctcctgcactggaaccagcagtgacgttggtggttataactttgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgagtattactgcagctcatatacaagcagtaccactctttatgtcttcggacgtgggaccaaggtcaccgtccta

SEQ ID NO: 4299 - DNA, 372 bp, Homo sapiens
caggtgcagctggtgcagtctggggctgaggtgaagaagcctggggcctcagtgaaggtctcctgcaaggcttctggatacaccttcatcggctactatatccactgggtgcgacaggcccctggacaagggcttgagtggatgggatggatcaaccctatcagtggtgtcacaaagtatgcacagaagttccagggcaaaatcaccatgaccagggacacgtccatcagcacagcctatatggagctgagcaggctgagatctgacgacacggccgtgtattattgtgcgagagagatagcagcagctgatggtcacttctactacggtttggacgtctggggccaaggcaccacggtcaccgtctcctca

SEQ ID NO: 4300 - DNA, 321 bp, Homo sapiens
gaaattgtgttgacgcagtctccaggcatcctgtctttgtctccaggggaaagagccaccctctcctgcagggccagtcagagtgttagcagcagctacttagcctggtaccagcagaaacctggccaggctcccaggctcctcatctatggtgcatccaccagggccactggcatcccagacaggttcagtggcggtgggtctgggacagacttcactctcaccatcagcagactggagcctgaagattttgcagtgtattactgtcagcagtatgatagctcacctcttttcggccctgggaccacggtggctatcaaa

SEQ ID NO: 4301 - DNA, 360 bp, Homo sapiens
cagctgcagctgcaggagtcgggcccaggactggtgaagccttcggagaccctgtccctcacctgcactgtctctggtggctccatcagcagtagtagttactactggggctggatccgccagccccccgggaaggggctggagtggattgggactatgtattatagtgggagcacctactacaacccgtccctcaagagtcgagtcaccatatcagtagacacgtccaagaaccagttctccctgaaactgacctctatgaccgccgcggacacggccgtgtattactgtgcgagagtccggcagtggctggtaccctttgactactggggccagggaaccctggtcaccgtctcctca

SEQ ID NO: 4302 - DNA, 318 bp, Homo sapiens
tcctatgagctgactcagccaccctcagtgtccgtgtccccagggcagacagccagcatcacctgctctggcgataaattggagaataaatatgtttgctggtatcagcagaagccaggccagtcccctgtgctggtcatctatcaagataccaagcggccctcagggatccctgagcgaatctctggctccagctctgggaacacagccactctgaccatcagtgggacccaggctatggatgaggctcactattactgtcaggcgtgggccagcagcactgccgtattcggcggagggaccaagctgaccgtccta

SEQ ID NO: 4303 - DNA, 366 bp, Homo sapiens
cagatgcagctggtgcagtctggggctgaggtgaagaagactgggtcctcagtgaaggtttcctgcaaggcttccggatacaccttcacctaccgctacctgcactgggtgcgacaggcccccggacatgcgcttgagtggatgggatggatcacacctttcaatggtgacacccactacgcacagaaattccaggacagagtcaccgttaccagggacaggtctatgggcacagcctacctggagctgagcagcctgagatctgacgacacagccatgtattactgtgcaagtggtcctatagtggctacgaccaatgatgcttttgatatctggggccaagggacaatggtcaccgtctcttca

SEQ ID NO: 4304 - DNA, 330 bp, Homo sapiens
cagtctgtgttgacgcagccgccctcagtgtctgcggccccaggacagaaggtcaccatctcctgctctggaagcaactccaacattgggagtaattttgtatcctggtaccagcagctcccaggaacagcccccaaactcctcatttatgacaataataagcgaccctcaggggttcctgaccgattctctggctccaagtctggcacgtcagccaccctgggcatcaccggactccagactggggacgaggccgattattactgcggaacatgggatagcagcctgagtgcttatgtcttcggaactgggaccaaggtcaccgtccta

SEQ ID NO: 4305 - DNA, 387 bp, Homo sapiens
caggtgcagctggtggagtctgggggaggcgtggtccagcctgggaggtccctgagactctcctgtgcagcctctggattcaccttcagtggctatggcatgcactgggtccgccaggctccaggcaaggggctggagtgggtggcacttatatcacatgatggaagtaatagatactatgcagactccgtgaagggccgattcaccatctccagagacaattccaagaacacgctgtatctgcaaatgaacagcctgagagctgaggacacggctctatattactgtgcgaaagatcgcctaggatattgtagtagtcccaactgtcccggcgggtccaactggttcgacccctggggccagggaaccctggtcaccgtctcctca

SEQ ID NO: 4306 - DNA, 336 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgaggcttcggccaagggacacgactggagattaac

SEQ ID NO: 4307 - DNA, 336 bp, Homo sapiens
caggtgcagctgcaggagtcgggcccaggactggtgaagccttcggagaccctgtccctcacctgcaatgtctctggtgactccatcagtggttactactggagttggatccggcagcccccagggaagggactggagtggattggatatatctattacagtgggagcaccacctacaacccctccctcaagagtcgagtcactatatcagtagacacgtccaagaaccagttctccctgaacctgagctctgtgaccgctgcggacacggccgtgtattactgtgcgagaggttttgactactggggccagggaaccctggtcaccgtctcctca

SEQ ID NO: 4308 - DNA, 324 bp, Homo sapiens
gaaattgtgttgacgcagtctccaggcatcctgtctttgtctccaggggaaagagccaccctctcctgcagggccagtcagagtgttagcagcatctacttagcctggtatcagcagaaacctggccaggctcccaggctcctcatctatggtgcatccagcagggccattggcatcccagacaagttcagtggcagtgggtctgggacagacttcactctcaccatcaacagactggagcctgaagattttgcagtgtattactgtcagcagtatggtagctcaccgtggacgttcggccaagggaccaaggtggaaatcaaa

SEQ ID NO: 4309 - DNA, 363 bp, Homo sapiens
caggtgcagctggtgcaatctgggtctgagttgaggaagcctggggcctcagtgaaggtttcctgcaaggcttctggatacaccttcactacccatggtatgagttgggtgcgacaggcccctggacaagggcttgagtggatgggatggatcaacaccaacactgggaacccaacgtatgcccaggacttcacaggacggtttgtcttctccgtggacagttctgtcagcacggcatatctgcagatcagcagcctaaaggctgaggacactgccgtgtattactgtgcgagagagcactttcgcgcggctgcgattgcatttgactactggggccagggaaccctggtcaccgtctcctca

SEQ ID NO: 4310 - DNA, 318 bp, Homo sapiens
gacatccagatgacccagtctccatcctccctgtctgcatctgtaggagacagagtcaccatcacttgccgggcaagtcagagcattagcaggtatttaaattggtatcaacagaaaccagggaaagcccctgagctcctgatctatactacatccactttgcaaagtggggtcccatcaaggttcagtggcagtggatctgagaccgagttcactctcaccatcagcagtctgcaacctgaagattttgcaacttactactgtcaacagacttacagtacccggacgttcggccaagggaccaaggtggaaatcaaa

SEQ ID NO: 4311 - DNA, 360 bp, Homo sapiens
caggtgcatcttgtggagtctgggggaggcgtggtccagcctgggaggtccctgagactctcctgtgcagcctctggatttaccctcagaagctatgctatgcactgggtccgccaggctccaggcaaggggctggagtgggtggctcttatatcatatgatgggagtgtcaaaaagtacgcagagtccgtgaagggccgaatcactgtctccggagacaactccaggaacacgctgcatctggaaattaacaccctcagagccgacgacacggctgtctattactgtgtgaggggcggtgtcagtggcccaaattcatttggtctctggggccaagggacaatggtcaccgtctcttca

SEQ ID NO: 4312 - DNA, 336 bp, Homo sapiens
gatgttgtgatgactcagtctccactctccctgcccgtcacccttggacaaccggcctccatctcctgcaggtctagtcaaagcctcgaatacagtgatggaaacacctacgtgaattggtttcagcagaggccaggccaatctccaaggcgcctaatttatcaggtttctaaccgggcctctggggtcccagacagattcagcggcagtgggtctggcactgatttcacactgcaaatcagcagggtggaggctgaggatgttggcatttattactgcatgcaagggacacactggccggtgacgttcggccaggggaccaaggtggaaatcaaa

SEQ ID NO: 4313 - DNA, 378 bp, Homo sapiens
caggtgcagctggtgcagtctggggctgaggtgaagaagcctggggcctcagtgaaggtctcctgcaaggcttctggatacaccttcagcgaccactatatgcactgggtgcgacaggcccccggacaagggcttgagtggatggggtggatcaaccctatcagtggtgtcacaaaccctgcacagaagtttcagggcagggtcaccatgaccagggacacgtccatcagtacagcctacatggagttgaccaggctgagatctgacgacacggccgtgtattactgtgcgagagagagctcactggcgtattactctgatactagtggttctctgattgactactggggccggggaaccctggtcaccgtctcctca

SEQ ID NO: 4314 - DNA, 327 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatagcagtctgcatgtggttttcggcggagggaccaagctgaccgtccta

SEQ ID NO: 4315 - DNA, 336 bp, Homo sapiens
caggtgcagctgcaggagtcgggcccaggactggtgaagccttcggagaccctgtccctcacctgcactgtctctggtgactccatcagtccttactactggagctggatccggcagcccccaggaaagggactagaatggattgggtatatctattacagtgggaggaccaactacaacccctccctcaagagtcgagtcaccatatcagtagacacgtccaagaaccagttctccctgaagctgacctctgtgaccgctgcggacacggccatttattactgcgcgagagatttcagcaactggggccagggaaccctggtcaccgtctcctca

SEQ ID NO: 4316 - DNA, 327 bp, Homo sapiens
gaaattgtgttgacgcagtctccaggcattctgtctttgtctccaggggaaagagccaccctctcctgcagggccagtcagagtgttagcagcaattacttagcctggtaccagcagaaacctggccaggctcccaggctcctcatctatgctgcatccagcagggccattggcgtcccagacaggttcagtggcagtgggtctgggacagacttcactctcaccatcagcagactggagcctgaagattttgcagtatattactgtcaccagtatggtagctcacttacgtggacgttcggccaagggaccaaggtggaaatcaaa

SEQ ID NO: 4317 - DNA, 363 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagatcgcttgggggtggatacacctatggttccgactactggggccagggaaccctggtcaccgtctcctca

SEQ ID NO: 4318 - DNA, 315 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcattcggcggagggaccaaggtggagatcaaa

SEQ ID NO: 4319 - DNA, 369 bp, Homo sapiens
caggtgcagctgcgggagtcgggcccaggactggtgaagccttcggagaccctgtccctcacctgcactttctctggtgactccatcagtacttactactggagctggatccggcagcccccagggaaggggctggagtggattgggtatatcttttacagtgggagcaccaagtacaacccctccctcaagagtcgagtcaccatgtcagcagacacgtccaagaaccagttctccctgaggctgagcgctgtgaccgctgcggacacggccgtgtattactgtgcgacctcggggaatcagcacgccgatagtagtggttattactttgactactggggccagggaaccctggtcaccgtctcctca

SEQ ID NO: 4320 - DNA, 324 bp, Homo sapiens
gaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaagagggccactggcatcccagccaggttcagtggcagtgggtctgggacagacttcactctcaccatcagcagcctagagcctgaagattttgcagtttattactgtcagcagcgtagcaactggctcccgctcactttcggcggagggaccaacgtggagatcaaa

SEQ ID NO: 4321 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcacttatctcatatgatggaagtaataaatactacgcagactccgtgaagggccgattcaccatctccagagacaattccaagaacacgctgtatctgcaaatgaacagcctgagagctgaggacacggctgtgtattactgtgcgagagccaccgggggcaactactactacggtatggacgtctggggccaagggaccacggtcaccgtctcctca

SEQ ID NO: 4322 - DNA, 324 bp, Homo sapiens
gacatccagttgacccagtctccatccttcctgtctacctctgtaggagacagagtcaccatcacttgccgggccagtcagggcattagcagttatttagcctggtatcagcaaaaaccagggaaagcccctaaactcctgatctatgctgcatccactttgcaaagtggggtcccatcaaggttcagcggcagtggatctgggacagaattcactctcacaatcagcagcctgcagcctgaagattttgcaacttattactgtcaacagcttaattcttaccccccgtacacttttggccaggggaccaagctggagatcaaa

SEQ ID NO: 4323 - DNA, 384 bp, Homo sapiens
caggtccagctggtacagtctggggctgaggtgaggaagcctggggcctcagtgaaggtctcctgcaaggtttccggttacaccctcactgaattatccatgcactgggtgcgacaggctcctggaaaagggcttgagtggatgggaggttttgatcctgaagatggtgaaagaatgtacgcacagaagttccagggcagagtcaccatgaccgaggacacatccacagacacagcctacatggaactgagcagcctgagatctgaggacacggccatctattactgtacaacagatctttcctatctgtggtcgggcaaactggaacctgactactggtacttcgctctctggggccgtggcaccctggtcactgtctcctca

SEQ ID NO: 4324 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagttgctcatttcctgggcatctacccgggaatccggggtccctgaccgattcagtggcagcgggtctgggacagaattcactctcaccatcagcagcctgcaggctgaagatgtggcagtttactactgtcagcaatattatggtactcctctgacttttggccaggggaccaagctggagatcaaa

SEQ ID NO: 4325 - DNA, 363 bp, Homo sapiens
caggtgcagctggtggagtctgggggaggcgtggtccagcctgggaggtccctgagactctcctgtgcagcctctggattcaccttcagtacctatggcatgcactgggtccgccaggctccgggcaaggggctggagtgggtggcagttatattctttgatggaagtaagacatactatgcagactccgtgaagggccgattcaccatctccagagacaattccaagaacacgctgtatctgcaaatgaacagcctgagagctgaggacacggctgtatattactgtgcgaaagagacatacggtgactacgaccaagctatggcctactggggccagggaaccctggtcaccgtctcctca

SEQ ID NO: 4326 - DNA, 324 bp, Homo sapiens
tcctatgtggtgactcagccaccctcagtgtcagtggccccaggaaagacggccatgattacctgtgggggaaacaacattggaagtaaaagtgtgcactggtaccagcagaagccaggccaggcccctgtgctggtcatctattttgatagcgaccggccctcagggatccctgagcgattctctggcgccaactctgggaacacggccaccctgaccatcagcagggtcgaagccggggatgaggccgagtattattgtcacgtgtgggatagtagtagtgatcatggggtgttcggcggagggaccaagctgaccgtccta

SEQ ID NO: 4327 - DNA, 393 bp, Homo sapiens
gaggtgcagctggtggagtctgggggaggcttggtccagccgggggggtccctgagactctcctgtgcagcctctggattcacctttagtagctattggatgagctgggtccgccagtctccagggaaggggctggagtgggtggccaacataaggcacgatggaagtgagaaatactatgtggactctgtgaagggccgattcaccatctccagagacaacgccaagaactcactgtatctgcaaatgaacagcctgagagccgaggacacggctgtgtattactgtgcgagagtctcgaggttctacgcacgagccggagagtcgggaggctactactactactacggtatggacgtctggggccaagggaccacggtcaccgtctcctca

SEQ ID NO: 4328 - DNA, 327 bp, Homo sapiens
gaaattgtgttgacgcagtctccaggcaccctgtctttgtctccaggggaaagagccaccctctcctgcagggccagtcagagtgtcagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcaatttattactgtcagcagtatggtaactcacctccgtacacttttggccaggggaccaagctggagatcaaa

SEQ ID NO: 4329 - DNA, 378 bp, Homo sapiens
caggtgcagctggtgcagtctggggctgaggtgaagaagcctggggcctcagttacggtttcctgcaaggcatctggatacagtttcaccacctactatatgcactgggtgcgacaggcccctggacaaggccttgagtggatgggcgtaatcaaccctagtgatggtagcacaaactacgcacagaagttccagggcagagtcaccatgaccagagacacgtccacgagcacaatctacatggacttgagcagcctgagatctgacgactcggccgtatattactgtgctagagatctgacggtgactacgggggttctcgactactactacggtttggacttctggggccaagggaccacggtcatcgtctcctca

SEQ ID NO: 4330 - DNA, 324 bp, Homo sapiens
tcctatgagctgacacagccaccctcggtgtcagtgtccccaggacagacggccaggatcacctgctctggagatgcattgccaaagcaatttgctcattggtaccagcagaagccaggccaggcccctgtagtggtgatctctaaggacactgagcggccctcagggatccctgagcgattctctggctccagctcagggaccacagtcacgttgaccatcagaggagtccaggcagaggacgaggctgactattactgtcaatcagcagacagcagtggtacttatgtggtattcggcggagggaccaagctgaccgtccta

SEQ ID NO: 4331 - DNA, 372 bp, Homo sapiens
caggtgcagctgcaggagtcgggcccaggactggtgaagccttcacagaccctgtccctcacctgcactgtctctggtggctccatcagcagtgatgattactactggtcctggatccgccagcacccagggaagggcctggagtggattgggtacatctattacagtgggagcacctactacaacccgtccctcaagagtcgagttaccatatcagtagacacgtccaagaaccagttctccctgaagctgagctctgtgactgccgcggacacggccgtgtattactgtgcgagagtgagaggatattgtagtagtaccaggtgccatgttgactactggggtcagggaaccctggtcaccgtctcctca

SEQ ID NO: 4332 - DNA, 327 bp, Homo sapiens
gaatttgtgttgacacagtctccagccaccctgtctttgtctccaggggaaagagccaccctctcctgcagggccagtcaaagtgttagcagctacttagcctggtaccaacagaaacctggccagcctcccaggctcctcatctatgatgcatccaacagggctactggcatcccaaccaggttcagtggcagtgggtctgggacagacttcactctcaccatcggcagcctagagcctgaagattttgcagtttattactgtcagcagcgtagcgactggcctccggggatcaccttcggccaagggacacgactggagattaaa

SEQ ID NO: 4333 - DNA, 363 bp, Homo sapiens
caggtgcagctggtggagtctgggggaggcgtggtccagcctgggaggtccctgagactctcatgtgcagcctctggattcaccttcagtacctatgctatacactgggtccgccaggctccaggcaaggggctggagtgggtggcagttatatcatatgatggaatcaataactactacgcagactccgtgaagggccgattcaccatctccagagacaattccaagaacacactgtatctgcaaatgaacagcctgagaactgaggacacggctgtgtattactgtgcgaggacccatggtgggagctaccgctctgcttttgatatctggggccaagggacaatcgtcaccgtctcttca

SEQ ID NO: 4334 - DNA, 324 bp, Homo sapiens
gaaatagtgatgacgcagtctccaaccaccctgtctctgtctccaggggaaagagccaccctctcctgcagggccagtcagagtgttagcagcaacttagcctggtaccagcagaaacctggccaggctcccaggctcctcatttatggtgcatccaccagggccactggtatcccagccaggttcagtggcagtgggtctgggacagagttcactctcaccatcagcagcctgcagtctgaagattttgcaatttattactgtcaccagtataataactggcctccgatcaccttcggccaagggacacgactggagattaag

SEQ ID NO: 4335 - DNA, 357 bp, Homo sapiens
caggtgcagctggtgcagtctggggctgaggtgaagaagcctggggcctcagtgaaggttttctgcaaggcatctggatacaccttcaccagccagtatgtgcactgggtgcgacaggcccctggacaaggacttgagtggatgggattgatcaaccctgacggtgataccacaagctccgcacagaagttccagggcagagtcaccatgaccagggacacgtccacgaccacagtctacatggagctgagcagcctgagatctgaggacacggccgtgtattactgtaccagcagcacctggttgagaggcggtatggacgtctggggccaagggaccagggtcaccgtctcttca

SEQ ID NO: 4336 - DNA, 333 bp, Homo sapiens
aattttttgctgactcagccccactctgtgtcggagtctccggggaagacggtaaccatctcctgcaccggcagcagtggctatattgccagcaactatgtgcagtggtaccagcagcgcccgggcagtgcccccacaattgtgatctatgaggataaccaaagaccctctggggtccctgatcggttctctggctccatcgacagttcctccaactatgcctccctcaccatctctggactgaagactgaggacgaggctgactactactgtcagtcttatcatagcagcaatcatgtggtgttcggcggagggaccaagctgaccgtccta

SEQ ID NO: 4337 - DNA, 387 bp, Homo sapiens
gaggtccagctggtacagtctggggctgaggtgaagaagcctggggctacagtgaaaatctcctgcaaggtttctggatacaccttcaccgactattacatgcactgggtgcaacaggcccctggaaaagggcttgagtggatgggacttattgatcctgaagatgatgaaacaatatccgcagagaggttcaagggcagagtcaccataaccgcggacacgtctacagacacagtgtacatggagctgagcagcctgagatctgaggacacggccgtgtattactgtgcaagagaaagtcgatctctaggatattgtactgctggtagttgctactcgtactcattcgacccctggggccagggaaccctggtcaccgtctcctca

SEQ ID NO: 4338 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccagactactcattcatggttcatccagcagggccactggcatcccagacaggttcagtggcagtgggtctgggacagacttcactctcaccatcagcagactggagcctgaagattttgcagtatattactgtcagcagtatggtagctcatcttcgatcaccttcggccaagggacacgactggagattaaa

SEQ ID NO: 4339 - DNA, 360 bp, Homo sapiens
caggtgcagctggtggagtctgggggaggcgtggtccagcctgggaggtccctgagactctcctgtgcagcctccggattcaccttcattacctatggcatgcactgggtccgccaggctccaggcaaggggctggagtgggtggcagttatatcatatgatggaaataatagatactatgcagactccgtgaggggccgattcaccatctccagagacaattccaagaacactctgtatctgcaaatgatcagcctgagaggtgaggacacggctgtgtactattgtgcgagagatcaagcggcagtggctggtcccattgactattggggccagggaaccctggtcaccgtctcctca

SEQ ID NO: 4340 - DNA, 318 bp, Homo sapiens
tcctatgagctgactcagccaccctcagtgtccgtgtccccaggacagacagccagcatcacctgctctggagataaattggagaataaatatgcttcctggtatcagcagaagccaggccagtcccctttgctggtcatctatcaggatgacaagcggccctcggggatccctgagcgattctctggctccagctctgggaacacagccactctgaccatcagcgagacccaggctatggatgaggctgactattactgtcaggcgtggggcagcagctctgtggtgttcggcggagggaccaagctgaccgtccta

SEQ ID NO: 4341 - DNA, 351 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcacttatatcatatgatggaactaataaatactacgcagactccgtgaagggccgaatcaccatctccagagacaattccaagaacacgctgtatctgcaaatgaacagcctgagagctgaggacacggctgtctattactgtgcgagagatcttggcagtggctggtctccctggggccagggaaccctggtcaccgtctcctca

SEQ ID NO: 4342 - DNA, 318 bp, Homo sapiens
tcctatgagctgactcagccaccctcagtgtccgtgtccccaggacagacagccagcatcacctgctctggagataacttgggggataaatatgtttgctggtatcagcagaagccaggccagtcccctgtactggtcatctatcaagatagcaagcggccctcagggatccctgagcgattctctggctccacctctgggaacacagccactctgaccatcagcgggacccagactatggatgaggctgactattactgtcaggcgtgggacagcagagctgcggtattcggcggagggaccaagctgaccgtccta

SEQ ID NO: 4343 - DNA, 363 bp, Homo sapiens
caggtgcagctggtggagtctgggggaggcgtggtccagcctgggaggtccctgagactctcctgtgcagcctctggattcaccttcagtatctatgctatgcactgggtccgccaggctccaggcaaggggctggagtgggtggcagttatatcatatgatggaattaataaatattatgcagactccgtcaagggccgattcaccatctccagagacaattccaagaacacgctgtatctgcaaatcaacagcctgagaactgaggacacggctgttttttactgtgcgaaatcccggggggggagctattcgaatgcttttgatatctggggccaggggacaatggtcaccgtctcttca

SEQ ID NO: 4344 - DNA, 321 bp, Homo sapiens
gaaattgtgttgacgcagtctccaggcaccctgtctttgtctccaggggaaagagccaccctctcctgcagggccagtcagagtgttagcagcagctacgtagcctggtaccagcagaaacctggccaggctcccaggctcctcatctatggtgcgtccagcagggccactggcatcccagacaggttcagtggcagtgggtctgggacagacttcactctcaccatcagcaggctggagcctgaagattttgcagtatattactgtcagcaatatcacctcggactcactttcggcggagggaccaaggtagagatcaaa

SEQ ID NO: 4345 - DNA, 357 bp, Homo sapiens
caggtgcagttggtgcagtctggggctgaggtgaagaagcctggggcctcagtgaaagtctcctgcaagacttctggatacaccttcaccgcctactatttgcagtgggtgcgacaggcccctggacaagggcttgagtggatgggatggatccaccctaacagtggtggcacaaactatgcacagaagtttcagggcagggtcaccatgaccagggacacgtccatcagcacagcctacatggagctgagcagtctgagatctgacgacacggccgtgtattactgtgcgagagacttagcagtggctgggtgctttgactactggggccagggaaccctggtcaccgtctcctca

SEQ ID NO: 4346 - DNA, 324 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctatattcactttcggccctgggaccaaagtggatgtcaaa

SEQ ID NO: 4347 - DNA, 381 bp, Homo sapiens
caggtgcagttggtggagtctgggggaggcgtggtccagcctgggaggtccctgagactctcctgtgccgcctctggatacatcttcagtagctacgccgtgcactgggtccgccaggccccaggcaaggggctggagtgggtggcagttatatcatatgatggaagcaataaatactacgcagactccgtgaagggccgattcaccatctccagagacaattccaagaacacgctgcatctgcaaatgaacagcctgagagctgaggacacggctgtgtattactgtgcgagagacacgccgcattattattctgatagcaagaacttccactacggtatggacgtctggggccaagggaccacggtcaccgtctcctca

SEQ ID NO: 4348 - DNA, 321 bp, Homo sapiens
gacatccagatgacccagtctccatcctccctgtctgcatctgtaggagacagagtcaccatcacttgccgggcaagtcagagcattagcctctatttaaattggtatcagcagaaaccagggaaggcccctaacctcctgatctatgctgcatccagtttgcaaagtggggtcccatcgaggttcagtggcagtggatctgggacagatttcactctcaccgtcagcagtctgcaacctgaagattttgcaacttactactgtcaacagacttacagtaccccgctcactttcggcggagggaccaaggtggagatcaaa

SEQ ID NO: 4349 - DNA, 360 bp, Homo sapiens
gaggtgcagctggtggagtctggaggagacttgatccagcctggggggtccctgagactctcctgtgcagcctctggggtcaccgtcactagaaactacatgagctgggtccgccaggctccagggaaggggctggagtgggtctcagttatttatcccggtggtagcacattctacgcagactccgtgaggggccgattcaccatctccagagacaattccaagaacacactgtatcttcaaatgaacagcctgagagccgaggacacggccgtgtattactgtgcgagagatacggtagcagctggtacggaaacttttgactcctggggccagggaaccctggtcaccgtctcctca

SEQ ID NO: 4350 - DNA, 309 bp, Homo sapiens
gacatccagatgacccagtctccatcctccctgtctgcatctgtcggagacagagtcaccatcacttgccggccaagtcagagcattagcaactatttaaattggtatcagcataaagtagggaaaacccctaaactcctcatctatggtgcatccaccttgcaaagtggggtcccatcaaggttcagtggcggtggatctgggacagatttcactctcaccatcagcagtctgcaacctgaagattttgcaacttactactgtcaacacggtttgacttttggccaggggaccaagctggagatcaaa

SEQ ID NO: 4351 - DNA, 375 bp, Homo sapiens
caggtccacctggtacagtctggggctgaggtgaagaagcctggggcctcagtgaaggtctcctgcaaggtttccggatacaccctcattgaattatccatgcactgggtgcgacaggctcctggaaaaggccttgagtggatggggggttttgatcctgaagatgctgaaacaatctacgcagagaagttccagggcagagtctccatgaccgaggacacatctactgacacagcctacatggagttgagcagcctgagatctgaggacacggccgtgtattattgtgcaacagccccggcggctttttatggttcgggatactactacggtatggacgtctggggccaagggaccacggtcactgtctcctca

SEQ ID NO: 4352 - DNA, 336 bp, Homo sapiens
gatattgtgatgacccagactccactctcctcacctgtcacccttggacagccggcctccatctcctgcaggtctagtcaaagcctcgtacacagtgatggaaacacttatttgagttggcttcagcggaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttccgctcactttcggcggagggaccaaggtggagatcaaa

SEQ ID NO: 4353 - DNA, 393 bp, Homo sapiens
caggtgcagctggtggagtctgggggaggcgtggtccagcctgggaagtccctgagactctcctgtgcagcctctggattcaccttcagtacctatactatacactgggtccgccaggctccaggcagggggctggagtgggtggcagctatttcatacgatggaagcgataaatactacgcagactccgtgaagggccgattcaccatctccagagacaattccaagaacacgctgtatctgcaaatgagcagcctgagacccgaggacacggctgtgtattactgtgggagagatcggcaatactacgatattttgactgattattaccttccaacatccgaatactactttgactactggggccagggaaccctggtcaccgtctcctca

SEQ ID NO: 4354 - DNA, 321 bp, Homo sapiens
gacatccagatgacccagtctccatcttccgtgtctgcatctgtaggagacagagtcaccatcacttgtcgggcgagtcagggtattaacagctggttagcctggtatcagcagaaaccagggaaagcccctcaactcctgatctattctgcatccagtttacaaagtggggtcccatcaaggttcagcggcagtggatctgggacagatttcactctcaccatcagcaacctgcagcctgaagattttgcaacttactcttgtcaacaggctcacagtttccctccgactttcggcggagggaccaaggtggagatcaaa

SEQ ID NO: 4355 - DNA, 363 bp, Homo sapiens
cagctgcagctgcaggagtcgggcccaggactggtgaagccttcggagaccctgtccctcagctgcactgtctctggtggctccctcagcagtagttttcactactggggctggatccgccagcccccagggaaggggctggcgtggattggcaatatctattatagtgggagcaccgactacaacccgtccctcaagagtcgagtcaccatatccatagacacgtccaagaaccagttctccctgaagctgagctctgtgaccgccgcagacacggctgtgtattattgtgcgagactcggttcggggagttattatactcttgactactggggccagggaatcctggtcaccgtttcctca

SEQ ID NO: 4356 - DNA, 327 bp, Homo sapiens
gacatccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttaaccatcagcagcctgcagcctgaagatattgcaacatattactgtcaacagtatgaaaatctccctccggggctcactttcggcggagggaccaaggtggagatcaaa

SEQ ID NO: 4357 - DNA, 375 bp, Homo sapiens
gaggtgcagttggtggagtctgggggaggcctggtcaagcctggggggtccctgagactctcctgtgtagcctctggattcaccttcagtaactataggatgaactgggtccgccaggctccagggaaggggctggagtgggtctcatccattagtagtagtcctagttacatatactacgcagactcagtgaagggccgattcaccatctccagagacaacgccaagaattcactttatctacaaatgaacagcctgagagccgaggacacggctgtgtattactgtgcgagagatcccgtggatacacctatggttcttggggtggggttttttgactactggggccagggaaccctggtcaccgtctcctca

SEQ ID NO: 4358 - DNA, 321 bp, Homo sapiens
gaaatagtgatgacgcagtctccagccaccctgtctgtgtctccaggggaaagagccaccctctcctgcagggccagtcagagtgttggcagcaacttagcctggtaccagcagaaacctggccaggctcccaggctcctcatctatggtgcatccaccagggccactggtgtcccagccaggttcagtggcagtgggtctgggacagagttcactctcaccatcagcagtctgcagtctgaagatttggcagtttattactgtcagcagtataatatctggctttggacgttcggccaagggaccaaggtggaaatcaaa

SEQ ID NO: 4359 - DNA, 387 bp, Homo sapiens
gaagtgcagctggtgcagtctggagcagaggtgaaaaagcccggggagtctctgaagatctcctgtaagggttctggatacagttttaccagcaagtggatcggctgggtgcgccagatgcccgggaaaggcctggagtggctgggggtcatctatcctggtgactctgataccagatacggtccgtccttccaaggccaggtcaccatctcagccgacaagtccaccagcaccgcctacctgcagtggagcagcctgaaggcctcggacaccgccatgtattactgtgcgagacgatcttattactatgcttcggggagtttttataaggcggggacgtctgcttttgacatctggggccaagggacaatggtcaccgtctcttca

SEQ ID NO: 4360 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcctccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagcctgagtggttcggtcttcggaactgggaccaaggtcaccgtccta

SEQ ID NO: 4361 - DNA, 360 bp, Homo sapiens
caggtgcagctgcaggagtcgggcccaggactggtgaagccttcggggaccctgtccctcacctgcgctgtctctggtggctccatcagcagtagtaactggtggagttgggtccgccagcccccagggaaggggctggagtggattggagaaatctatcatagtgggagcaccaactacaacccgtccctcaagagtcgagtcactatatcagtagacaagtccaagaaccagttctccctgaaactgaactctgtgaccgccgcggacacggccatgtattactgtgcgagagcgtggagcagcagccaaagagggttcgacccctggggccagggaaccctggtcagtgtctcctca

SEQ ID NO: 4362 - DNA, 330 bp, Homo sapiens
cagtctgccctgactcagcctgcctccgtgtctgggtctcctggacagtcgatcaccatctcctgcactggaaccagcagtgatgttgggagttataacgttgtctcctggtaccaacaacacccaggcaaagcccccaaactcatgatttatgacgtcagtaagaggccctcaggggtttctaatcgcttctctggctccaagtctggcaacacggcctccctgacaatctctgggctccaggctgaggacgaggctgattattactgctgttcatatgtaggtagtagcacttgggtgttcggcggagggaccaagctgaccgtccta

SEQ ID NO: 4363 - DNA, 381 bp, Homo sapiens
gaggtgcagttgttggagtctgggggaggcttggtacagcctggggggtccctgagactctcctgtgcagcctctggattcaattttagcagctatgccatgacctgggtccgccaggctccagggaaggggctggagtgggtctcaggtattagtggtagtgggagtagtacatactacgcagagtccgtgaagggccggatcaccatctccagagacaattccaagaaaacgctgtctctgcaattgaacagcctgagagccgaggacacggccgtatattactgtgcgaaagataggccgttttacgatattttgactggtttgcctggctacggtatggacgtctggggccaagggaccacggtcaccgtctcctca

SEQ ID NO: 4364 - DNA, 321 bp, Homo sapiens
gacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccatcttgcaaagtggggtcccatcaaggttcagcggcagtggatctgggacagatttcactctcaccatcagcagcctgcagcccgaagactttgcaacttactattgtcaacaggctaacagtatcccgctcactttcggcggagggaccaaggtggagatcaaa

SEQ ID NO: 4365 - DNA, 363 bp, Homo sapiens
caggtgcacctggtggagtctgggggaggtggggtccagcctgggaggtccctgagactctcctgtgcagcctctggattcaccttcatgacctatgctatgcactgggtccgccaggctccaggcaaggggctggagtgggtggcagttatatcatatgatggaaataatagatactacgcagactccgtgaggggccgattcaccatctccagagacaattccaagaacacgctgtatcttcaaatgaacagcctgagagctgaggacacggctgtttattactgtgcgagatcccggggggggagctactcgaatgcttttgatatctggggccaagggacaatggtcaccgtctcttca

SEQ ID NO: 4366 - DNA, 321 bp, Homo sapiens
gagattgtgttgacgcagtctccaggcaccctgtctttgtctccaggggaaagagccaccctctcctgcagggccagtcagactgttagcagcacttacttagcctggtaccagcagaaacctggccaggctcccaggctcctcatctatggtgcatccagcagggcctctggcatcccagacaggttcagtggcagtgggtctgggacagacttcactctcaccatcagcagactggagcctgaagattttgcagtgtattactgtctgcagtatcagctcggattcactttcggcggagggaccaaggtggagatcaag

SEQ ID NO: 4367 - DNA, 381 bp, Homo sapiens
caggtgcagctgcaggagtcgggcccaggactggtgaagccttcacagaccctgtccctcacctgcactgtctctggtggctccgtcagcagtggtgattactactggagttggatccgccagcccccagggaggggcctggagtggattgggttcatctattacagcgggagcacctactacaacccgtccctcaagagtcgagttaccatatcagtagacacgtccaagaaccagttctccctgaagctgacctctgtgactgccgcagacacggccgtttattactgtgccagagaaccctttcgggcacgtcgagacctccccgggggaggcggtatggacgtctggggccaagggaccacggtcaccgtctcctca

SEQ ID NO: 4368 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaggctgttcatttactgggcatctacccgggaatccggggtccctgaccgattcagtggcagcgggtctgggacagatttcactctcaccatcagcagcctgcaggctgaagatgtggcagtttattactgtcagcaatattataatactcctcgaacgttcggccaagggaccaaggtggaaatcaaa

SEQ ID NO: 4369 - DNA, 363 bp, Homo sapiens
caggtgcacctggtggagtctgggggaggcgtggtccagcctgggaggtccctgagactctcctgtgcagcctctggattcaccttcagtacctatgctatgcactgggtccgccaggctccaggcaaggggctggagtgggtggcacttatatcatatgatgcaggtaataaatactacgcagactccgtgaagggccgattcaccatctccagagacaattacaagaacacgctggatctgcaagtgaacagcctgagacctgaggacacggctgtgtattactgtgcgagagggagagggggctcctacttctacggtatggacgtctggggccaagggaccacggtcaccgtctcctca

SEQ ID NO: 4370 - DNA, 321 bp, Homo sapiens
gacatccagatgacccggtctccatcttccgtgtctgcatctgtaggagacagagtcaccatcacttgtcgggcgagtcagggtattagcacctatttagcctggtatcaacacaaaccagggacagcccctaagctcctgatctatgctgcatccagtttgcaaagtggggtcccatcacggttcagcggcagtggatctgggacagatttcactctcaccatcagcaacctgcagcctgaagattttgcaacttactattgtcaacagactaacagtttccctcagactttcggcggagggaccaaggtggagatcaaa

SEQ ID NO: 4371 - DNA, 363 bp, Homo sapiens
caggtgcaactgcaggagtcgggcccaggactggtgaagccttcacagaccctgtccctcacctgcactgtctctggtgactccatcagcagtggtggttactactggagctggatccgccagcacccagggaagggcctggagtggattgggtacatcttttacagtgggagcacctactacaacccgtccctcaagagtcgagttaccatatcagtagacacgtctaagaaccagttctccctgaagctgagctctgtgactgccgcggacacggccgtctattactgtgcgagagattcagtggctggtttttcaatatttgacttctggggccagggaaccctggtcaccgtgtcctca

SEQ ID NO: 4372 - DNA, 324 bp, Homo sapiens
tcgtctgagctgtctcaggaccctgctgtgtctgtggccttgggacagacagtcaggatcacatgccaaggagacagcctcagaagctattatgcaagctggttccagcagaagccaggacaggcccctgtacgtgtcatctatggtaaaaacaaccggccctcagggatcccagaccgattctctggctccagctcaggaaacacagcttccttgaccatcactggggctcaggcggaagatgaggctgactattattgtaactcctgggacagcagtactaaccatgtgcttttcggcggagggaccaagctgaccgtccta

SEQ ID NO: 4373 - DNA, 375 bp, Homo sapiens
cagctgcagctgcaggagtcgggcccaggactggtgaagccttcggagaccctgtccctcacctgcactgtctctggtggctccatcagaagtagtagttactactggggctggatccgccagcccccagggaaggggctggagtggattgggagtatctattatagtgggagcacctacttcaacccgtccctcaagagtcgagtcaccatatccgtagacacgtccaagaaccagttctccctgaagctgagctctgtgaccgccgcagatacggctgtgtattactgtgcgatactatggttcgggaagtccgtatactactactacgatatggacgtctggggccaagggaccacggtcaccgtctcctca

SEQ ID NO: 4374 - DNA, 333 bp, Homo sapiens
cagtctgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtctttgggtgttcggcggagggaccaagctgaccgtccta

SEQ ID NO: 4375 - DNA, 372 bp, Homo sapiens
caggttcagctggtgcagtctggagctgaggtgaagaagcctggggcctcagtgaaggtctcctgcaagacttctggttacacttttaccttctatggtatcacctgggtgcgacaggcccctggacaagggcttgagtggatgggatggatcagcgcttacactggtaacacaagctatgcacagaagctccagggcagagtcaccttgaccacacacacatccacgagcacagtctacatggaactgaggagcctgagatctgacgacacggccgtgtattactgtgcgagaggcgttttcactggtttttatagggcccctaacggtatggacgtctggggccaagggaccacggtcaccgtctcctca

SEQ ID NO: 4376 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgaggtcagtaatcggccctcaggggtttctaatcgcttctctggctccaagtctggccacacggcctccctgaccatctctgggctccaggctgaggacgaggctgattattactgcagctcgtatacaagcagcagcactctttatgtcttcggaactgggaccaaggtcaccgtccta

SEQ ID NO: 4377 - DNA, 369 bp, Homo sapiens
caggtgcagctacagcagtggggcgcaggactgttgaagccttcggagaccctgtccctcacctgcgctgtctatggtgggtccttcagtggttacttctggagctggatccgccagccccccgcgaaggggctggagtggattggggacatcaatcatagtggaagcaccaactacaacccgtccctcaagagtcgggtcaccatatcagtagacacgtccaagaaccagttctccctgaagctgagctctgtgaccgccgcggacacggctgtgtattactgtgcgagaggagaacccaagttttattactctggttcggggggttacagttcctggggccagggaaccctggtcaccgtctcctca

SEQ ID NO: 4378 - DNA, 324 bp, Homo sapiens
gaaatagtgatgacgcagtctccagccaccctgtctgtgtctccaggggaaagagccaccctctcctgcagggccagccagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggcctccgatcaccttcggccaagggacacgactggagattaaa

SEQ ID NO: 4379 - DNA, 378 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatagtggaagtaataaatactacgcagactccgtgaagggccgattcaccatctccagagacagttccaagaatacgctgtatctgcaaatgaacagccttagagctgaggacacggctgtgtattactgtgcgagagatagtctaggcctacacgatactggtggaaccgacaactactttgactactggggccagggaaccctggtcaccgtctcctca

SEQ ID NO: 4380 - DNA, 318 bp, Homo sapiens
gaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgtatccaccagggccactggtatcccagccaggttcagtggcagtgggtctgggacagagttcactctcaccatcagcagcctgcagtctgaagattttgcagtttattactgtcagcagtataataactggtggacgttcggccaagggaccaaggtggaaatcaaa

SEQ ID NO: 4381 - DNA, 357 bp, Homo sapiens
cagatcaccttgaaggagtctggtcctacgctggtgaaacccacacagaccctcacgctgacctgcaccttctctgggttctcactcagcattagtggagtgggtgtgggctggctccgtcagcccccaggaaaggccctggagtggcttgcactcatttattgggatgatgataagcgctacagcccatctctgaagagcaggctcaccatcagcaaggacacctccaaaaaccaggtggtccttaaaatgaccaacattgaccctgtggacacagccacatattactgtgcacaccattcgattagcaccatctttgaccactggggccagggaaccctggtcaccgtctcctca

SEQ ID NO: 4382 - DNA, 327 bp, Homo sapiens
cagtctgccctgactcagcctgcctccgtgtctgggtctcctggacagtcgatcaccatctcctgcactgcaaccagcagtgacgttggtgattataactatgtctcctggtaccaacaacacccaggcaaagcccccaaactcatgatttttgaggtcagtgatcggccctcggggatttctaatcgcttctctggctccaagtctggcaacacggcctccctgaccatctctgggctccaggctgaggacgaggctgattattactgcagctcatatacaaccagcagcgctgtattcggcggagggaccaagctgaccgtccta

SEQ ID NO: 4383 - DNA, 363 bp, Homo sapiens
caggtgcaactggtggagtctgggggaggcgtggtccagcctgggaggtccctgagactctcctgtgcagcctctggattcaccttcagtagctttgctatgcactgggtccgccaggctccaggcaaggggctggagtgggtggcagtgatatcatatgatggaagtcacaaatactatgcagactccgtgaagggccgagtcaccatctccagagacaactccaagaacacgctgtatttgcaaatgaacagcctgagagttgaggacacggctgtattttactgtgcgaaagacgattgtggtggtggtgtatgcttcccagactactggggccagggaaccctggtcaccgtctcctca

SEQ ID NO: 4384 - DNA, 330 bp, Homo sapiens
cagtctgccctgactcagcctgcctccgtgtctgggtctcctggacagtcgatcaccatctcctgcactggaaccagcagtgacgttggtggttataattatgtctcctggtaccaacagcacccaggcaaagcccccaaactcatgatttttgaggtcaagattcggccctcaggggtttctgatcgcttctctggctccaggtctggcaacacggcctccctgaccatctctgggctccaggctgaggacgaggctgcttattactgcagctcatatacaagcagcagcactctggtcttcggcggagggaccaagctgaccgtccta

SEQ ID NO: 4385 - DNA, 354 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtggattgggtatatctattacagtgggagcaccaactacaacccctccctcaagagtcgaatcaccatatcactagacacgtccaagaaccagttctccctgaagctgagctctgtgaccgctgcggacacggccgtgtattactgtgcgaccattaactacgctgactacgcccttgactactggggccagggaaccctggtcaccgtctcctca

SEQ ID NO: 4386 - DNA, 327 bp, Homo sapiens
aattttatgctgactcagccccactctgtgtcggaggctccggggaagacggtaaccatctcctgcaccggcagcagtggcagcgttgccagcaactatgtgcagtggtaccagcagcggccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcgtggtattcggcggagggaccaagctgaccgtccta

SEQ ID NO: 4387 - DNA, 372 bp, Homo sapiens
caggtgcagctggtggagtctgggggaggcgtggtccagcctgggaggtccctgagactctcctgtgcagcctctggcttcaccttcagtacctatgctatacactgggtccgccaggctccaggcaaggggctggagtgggtggcagttatatcatatgatggaagtaataaatactacgcagactccgtgaagggccgattcaccatctccagagacgattccaagaacacgctgtatctgcaaatgaacagcctgagagctgaggacacggctgtgtattactgtgcgagagatgttgcgacttataacaggtactattacttcggtatggacgtctggggccaagggaccacggtcaccgtctcctca

SEQ ID NO: 4388 - DNA, 330 bp, Homo sapiens
cagtctgtgctgactcagccaccctcagcgtctgggacccccggacagagagtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggtcttgtcttcggaactgggaccaaggtcaccgtccta

SEQ ID NO: 4389 - DNA, 366 bp, Homo sapiens
caggtgcagttgcaggagtcgggcccaggactggtgaagccttcggagaccctgtccctcacctgcactgtctctggtggctccgtcagcagtggtagttactactggagctggatccggcagcccccagggaagggactggagtggattgggtatatctattacagtgggaacaccaattacaacccctccctcaagagtcgagtcaccatatcagtagacacgtccaagaaccagttctccctgaagctgagctctgtgaccgctgcggacacggccgtgtattactgtgcgagagcccccgtggctacgttctatatgatctttgactactggggccagggaaccctggtcaccgtctcctca

SEQ ID NO: 4390 - DNA, 318 bp, Homo sapiens
gacatccagatgacccagtctccatcctccctgtctgcatctgtaggagacagagtcaccatcacttgccgggcaagtctgagcattcgtaactatttaaattggtatcagcagaaaccagggaaagcccctaagctcctgatctatgctgcatccagtttgcaaagtggggtcccatcaagattcagtggcagtggatctgggacagatttcactctcaccatcagcagtctgcaacctgaagattttgcaacttactactgtcaacagagttacaataccctcactttcggccctgggaccaaagtggatatcaaa

SEQ ID NO: 4391 - DNA, 351 bp, Homo sapiens
gaggtgcagctggtggagtctggaggaggcttgatccagcctggggggtccctgagactctcctgtgcagcctctggggtcaccgtcagtagcaactacatgaactgggtccgccaggctccagggaaggggctggagtgggtctcagttatttatagcggtggtagcacattctacgcagactccgtgaagggccgattcaccatctccagagacaattccaggaacacactgtatcttcaaatgaacagcctgagagccgaggacacggccgtgtattactgtgcgagagacgggtacttttacggtatggacgtctggggccaagggaccacggtcaccgtctcctca

SEQ ID NO: 4392 - DNA, 318 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcagcagcctgcagcctgaagattttgcaacttattactgtcaacaggttaatagttacccaattttcggccctgggaccaaagtggatatcaaa

SEQ ID NO: 4393 - DNA, 384 bp, Homo sapiens
caggtgcagctggtgcaatctgggtctgagttgaagaagcctggggcctcagtgaaggtttcctgcaaggcttctggatacaccttcactaactatgctatgaactgggtgcgacaggcccctggacaagggcttgagtggatgggatggatcaacaccaacactgggaacccaacatatgcccagggcttcacaggacggtttgtcttctccttggacacctctgtcagcacggcatatcttcagatcagcagcctaaaggctgaggacactgccatgtattactgtgcgagtactgcgtttttagagagaagttcttattggcaggccatggcagactactttgactactggggccagggaaccctggtcaccgtctcctca

SEQ ID NO: 4394 - DNA, 333 bp, Homo sapiens
cagtctgccctgactcagcctccctccgcgtccgggtctcctggacagtcagtcaccatctcctgcactggaaccagcagtgacgttggtggttataactctgtctcctggtaccaacagcacccaggcaaagcccccaaactcatgatttatgaggtcactaagcggccctcaggggtccctgatcgcttctctggctccaagtctggcaacacggcctccctgaccgtctctgggctccagggtgacgatgaggctgattactactgcagctcatatgtaggcagcagcaattccgtggtattcggcggagggaccaagctgaccgtccta

SEQ ID NO: 4395 - DNA, 372 bp, Homo sapiens
caggtgcagctgcaggagtcgggcccaggactggtgaagccttcggagaccctgtccctcacctgcactgtctctggtggctccatcagtacttactactggagctggatccggcagcccccagggaagggactcgaatggattgggtatatcttttacagtgggagcaccaactacaacccctccctcaaaagtcgagtcaccatatcaatggacacgtccaagaaccagttctccctgaagctgagctctgtgaccgctgcggacacggccgtgtattactgtgcgcgacaccaggcgatatattattctggttcggggaattgctggttcgacccctggggccagggaaccctggtcaccgtctcgtca

SEQ ID NO: 4396 - DNA, 324 bp, Homo sapiens
tcgtctgagctgactcaggaccctgctgtgtctgtggccttgggacagacagtcaggatcacatgccaaggagacagcctcagaagcaactatgcaagctggtaccagcagaagccaggacaggcccctgtacgtgtcatctatggtagagacaatcggccctcagggatcccagaccgattctctggctccagctcaggaaacacagcttccttgaccatcactggggctcaggcggaagatgaggctgactattactgtaattcttgggacagcagtggtaaccatgtggtgttcggcggagggaccaagctgaccgtccta

SEQ ID NO: 4397 - DNA, 369 bp, Homo sapiens
gaagtgcacctggtggagtctgggggaggcttggtacagcctggcaggtccctgagactctcctgtgcagcctctggattcacctttgatgattatgccatgcactgggtccggcaagttccagggaagggcctggagtgggtctcaggtattagttggaatagtggtagcatacactatgcggactctgtgaagggccgattcaccatctccagagacaacgccaagaactccctgtatctgcaaatgaacagtctgagagctgaggacacggccttgtattactgtacaaaaggccgatttttggagtggttaccaaggggggccattgactactggggccagggaaccctggtcaccgtctcctca

SEQ ID NO: 4398 - DNA, 351 bp, Homo sapiens
cagcctgtgctgactcagccaccttctgcatcagcctccctgggagcctcggtcacactcacctgcaccctgagcagcgactacagtaattataaagtggactggtaccagcagagaccagggaagggcccccggtttgtgatgcgagtgggcactggtgagattgtgggatccaaggggcatggcatccctgatcgcttctcagtcttgggtttaggcctgaatcggtacctgaccatcaagaacatccaggaagaggatgagagtgactaccactgtggggcagaccatggcagtgggagcaacttcgttccttgggtgttcggcggagggaccaagctgaccgtccta

SEQ ID NO: 4399 - DNA, 366 bp, Homo sapiens
caggtgcagctgcaggagtcgggcccaggactggtgaagccttcggagaccctgtccctcacctgcactgtctctgatggctccatcagtaattactactggagctggatccggcagcccccagggaagggactggagtggattgggtatctctattacagtgggagcaccaactacaacccctccctcaagagtcgagtctccatatcagttgacacgtccaagaaccagttctccctgaagttgtactctgtgaccactgcggacacggccgtgtattactgtgcgagagtccggttcggggagttgttatgggagaagtactttgactactggggccagggaaccctggtcaccgtctcctca

SEQ ID NO: 4400 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaacctcctgatctataaggcgtctagtttagaaagtggggtcccatcaaggttcagcggcagtggatctgggacagaattcactctcaccatcagcagcctgcagcctgatgattttgcaacttattactgccaacagtataaaaattattttccgacgttcggccaagggaccaaggtggaaatcaga

SEQ ID NO: 4401 - DNA, 357 bp, Homo sapiens
cagatcaccttgaaggagtctggtcctacgctggtgaaacccacacagaccctcacgctgacctgtagcttctctgggttctcactcagcactagtggagtgggtgtgggctggatccgtcagcccccaggaaaggccctggagtggcttgcactcatttattgggacggtgataagcgctacagcccatctctgaagagtaggctcaccatcaccaaggacacctccaaaaaccaggtggtccttacaatgaccaacatggaccctgtggacacagccacatattactgtgcgcacagacgggcgatatttgagttcgacccctggggccagggaaccctggtcaccgtctcctca

SEQ ID NO: 4402 - DNA, 321 bp, Homo sapiens
tcctatgagctgactcagccaccctcagtgtccgtgtccccaggacagacagccagcatcacctgctctggagataaattgggggatatatatacttactggtatcagcaaaagccaggccagtcccctgtgttggtcatctatcaagatagcaagcggccctcagggatccctgagcgattctctggctccagctctgggaacacagccactctgaccatcagcgggacccaggctatggatgaggctgactattactgtcaggcgtgggacggcaacactgccgtggtattcggcggagggaccaagctgaccgtccta

SEQ ID NO: 4403 - DNA, 366 bp, Homo sapiens
caggtgcagctggtggagtcggggggaggcgtggtccagcctgggaggtccctgagactctcctgtgcagcctctggattcaccttcagtaactatgctatgcactgggtccgccaggctccaggcaaggggctggagtgggtggcacttatatcatatgatggaactaacaaatactacgcagactccgtgaagggccgattcaccatttccagagacaactccaagaacacgctgtatttgcaaatgaacagcctgagagctgaggacacggctgtgtattactgtgcgaaattgcaaggttcggggagttattataaccccattgactactggggccagggaaccctggtcaccgtctcctca

SEQ ID NO: 4404 - DNA, 321 bp, Homo sapiens
gaaattgtgttgacgcagtctccaggcaccctgtctttgtctccaggggaaagagccaccctctcctgcagggccagtcagagtgttaccagcagctatttagcctggtaccagcagaaacctggccaggctcccaggctcctcatctatggtgcatccagcagggccactggcatcccagacaggttcagtggcagtgggtctgggtcagacttcactctcaccatcagcagactggagcctgaagattttgcagtgtattactgtcagcagtatggtagctcgtacacttttggccaggggaccaagctggagatcaaa

SEQ ID NO: 4405 - DNA, 360 bp, Homo sapiens
gaggtgcagctggtgcagtctggagcagaggtgaaaaagcccggggagtctctgaagatctcctgtaagggttctggatacagctttaccaactactggatcggctgggtgcgccagatgcccgggaaaggcctggagtggatggggatcatccatcctagtgactctgataccagatacagcccgtccttccaaggccaggtcaccatctcagtcgacaagtccctcagcaccgcccacctgcagtggagcagcctgaaggcctcggacaccgccatgtattactgtgcgagacatcatgattactatgatattagtggctatatctggggccaagggacaatggtcaccgtctcttca

SEQ ID NO: 4406 - DNA, 327 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctaagctggtgatatataaagacagtgagaggccctcagggatccctgagcgattttctggctccagctcagggacaacagtcacgttgaccatcagtggagtccaggcagaagacgaggctgactatcactgtcaatcagcagacttcagtggtagttatcctgtggtattcggcggagggaccaaactgaccgtccta

SEQ ID NO: 4407 - DNA, 387 bp, Homo sapiens
caggtgcagctggtggagtctgggggaggcgtggtccagcctgggaagtccctgagactctcctgtacagcctctggattcaccttcagtagctatgctatgcactgggtccgccaggctccaggcaaggggctggaatgggtggcagtgatattatatgatggaactgatgaatattacgcagactccgtgaagggccgattcaccatctccagagacaactccaagcacacgctgtatctgcaaatgaacagcctgagaactgaggacacggctgtgtattactgtgcgagagatgctgcggctggtataggagagtggctggtaacatccccctcgtgctactttgactactggggccagggaaccctggtcaccgtctcctca

SEQ ID NO: 4408 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaacctcctgatgtataaggcgtctagtttagaaagtggggtcccatcaaggttcagcggcagtggatctgggacagaattcactctcaccatcagcagcctgcagcctgatgattttgcaacgtattactgccaacagtataatagttaccccgggacgttcggccaagggaccaaggtggaaatcaaa

SEQ ID NO: 4409 - DNA, 360 bp, Homo sapiens
caggtgcagctggtggagtcggggggaggcgtggtccagcctgggaggtccctgagactctcctgtgcggcctctggattcacgttcagtacctatgctatgcactgggtccgccaggctccaggcaaggggctggaatgggtggcacttatctcatatgatggaattaataaatactacgcagactccgtgaggggccgattcaccttctccagagacaattccaagaacacgctgtatctgcaaatgaacaccctgagacctgaggacacggctgtgtattactgtgcgagggggggttcggggacttattactactttgaccagtggggccagggaaccctggtcaccgtgtcctca

SEQ ID NO: 4410 - DNA, 330 bp, Homo sapiens
cagtctgtgctgacgcagccgccctcagtgtctggggccccagggcagagggtcaccatctcctgcactgggagcagctccaacatcggggcaggttatgatgtacactggtaccagctgcttccaggaacagcccccaaactcctcatctatcgtaacaacaatcggccctcaggagtccctgaccgattctctggctccaactctggcacctcagcctccctggccatcactgggctccaggctgaggatgaggctgattattactgccagtcctttgacagcagtgtgaatcaggtgttcggcggagggaccaagctgaccgtccta

SEQ ID NO: 4411 - DNA, 381 bp, Homo sapiens
caggtgcagctggtggagtctgggggaggcgtggcccagcctgggaggtccctgagactctcctgtgcagcgtctggattcaccttcagtcactatggcatgcactgggtccgccaggctccaggcaaggggctggagtgggtggcagttatctggtatgatggaagtaatcaatactatgcagactccgtgaagggccgattcaccatctccagagacaattccaagaacacgttgtatctgcaaatgaacagcctgagagccgacgacacggctgtgtattattgtgcgaaaaaggggggcggcccctattgtggtggtgactgctcttcgggctacttcgatctctggggccgtggcaccctggtcactgtctcgtca

SEQ ID NO: 4412 - DNA, 324 bp, Homo sapiens
gacatccagatgacccagtctccatcctccctgtctgcatctgtaggagacagagtcaccatcacttgccaggcgagtcaggacattagcaactgtttaaattggtatcagcacaaaccagggaaagcccctgagctcctgatctacgatgcatccaatttggagccaggggtcccatcaaggttcagtggaagtggatctgggacagattttactttcaccatcagcagcctgcagcctgaagatattgcaacatattactgtcaacagtatgataatgtcccttcgatcaccttcggccaagggacacgactggaaattaaa

SEQ ID NO: 4413 - DNA, 384 bp, Homo sapiens
caggtgcagctacagcagtggggcgcaggactgttgaagccttcggagaccctgtccctcacctgcgctgtctatggtgagtccttcagtgcttactactggagctggatccgccagcccccagggaaggggctggagtggattggggaaatcaatcatagtggaagcaccacctacaacccgtccctcaagagtcgagtcaccatatctgtagacacgtccaagaatcagttctccctgaagctgagctctgtgaccgccgcggacacggctgtatattattgtgcgcgaaagggaaggtgggcccggtatagcagtggctggtacacctaccagtacggtctggacgtctggggccaagggaccacggtcaccgtctcctca

SEQ ID NO: 4414 - DNA, 327 bp, Homo sapiens
gaaattgtgctgacgcagtctccaggcaccctgtctttgtctccaggggaaggagccaccctctcctgcagggccagtcagactgttagcagcaactacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcactatggtaggtcacctcctttcactttcggccctgggaccaaagtggatatcaaa

SEQ ID NO: 4415 - DNA, 345 bp, Homo sapiens
gaggtgcagctggtggagtctggaggaggcttgatccagcctggggggtccctgagactctcctgtgcagcctctgggttaatagtcagtagaaattacatgtactgggtccgccaggctccagggaaggggctggaatgggtctcacttatttatagcggtggtagtacatactacgcagactccgtgaagggccgattcaccatctccagagacaattccaagaacacgctgtatcttcaaatgaacagcctgagagccgaggacacggccgtgtattactgtgcgagaggtccgtacggtgaaagtgtctggggccaagggaccacggtcaccgtctcctca

SEQ ID NO: 4416 - DNA, 321 bp, Homo sapiens
gacatccagatgacccagtctccatcctccctgtctgcatctgtgggagacagagtcaccatcacttgccaggcgagtcaagacattaacaagtatttaaattggtatcagcagaaaccagggaaagcccctaagctcctgatctacgatgcatccaatttggaaacaggggtcccatcaaggttcagtgggagtggatctgggacagattttagtttcaccatcagcagcctgcagcctgaagatattgcaacatattactgtcaacagtatgataatctcccgctcactttcggcggagggaccaaggtggagatcaaa

SEQ ID NO: 4417 - DNA, 363 bp, Homo sapiens
caggtgcagctggtggagtctgggggaggcgtggtccagcctgggaggtccctgagactctcctgtgcagcctctggattcaccttcagtatctatgctatgcactgggtccgccaggctccaggcaaggggctggagtgggtggcagttatatcatatgatggaagtcacaaatattatgtagactccgtgaagggccgattcaccatctccagagacaattccaagaacacgctgtatctgcaaatgaacagcctgagagctgaggacacggctgtgtattactgtgcgaggagcggttcggggaattataataattggttcgatccctggggccagggaaccctggtcaccgtctcctca

SEQ ID NO: 4418 - DNA, 321 bp, Homo sapiens
gaaattgtgttgacgcagtctccaggcaccctgtctttgtctccaggggaaagagccaccctctcctgcagggccagtcacagtgttagcagcagttacttagcctggtaccagcagaaacctggccaggctcccaggctcctcatatatggtgcatccagcagggccactggcatcccagacaggttcagtggcagtgggtctgggacagacttcactctcaccatcagcagactggagcctgaagattttgcagtgtattactgtcagcagtatggtagcgggtggacgttcggccaagggaccaaagtggaaatcaaa

SEQ ID NO: 4419 - DNA, 384 bp, Homo sapiens
caggtgcagctgcaggagtcgggcccaggactggtgaagccttcggagaccctgtccctcacctgcactgtctctggtggctccgtcaccagtggtagttactactggagttggatccggcagcccccagggaagggactggagtggattgggtatatgtattacagtgggagcatcaactacaacccctccctcaagagtcgagtcaccacatcagtagacacgtccaagaaccaggtctccctgaagctgaggtctgtgaccgctgcggacacggccgtgtattactgtgcgagagggcagattcattactatgatagtagtggttaccggttcccctggttcgacccctggggccagggaaccctggtcaccgtctcctca

SEQ ID NO: 4420 - DNA, 333 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacaacaatcggccctcaggggtccctgaccgattctctggctccaagtctggcacctcagcctccctggccatcactgggctccaggctgaggatgaggctgattattattgccagtcctatgacagcagcctgagtggtgtggtattcggcggagggaccaagctgaccgtccta

SEQ ID NO: 4421 - DNA, 366 bp, Homo sapiens
caggtgcagctggtggagtctgggggaggcgtggtccagccggggaggtccctgagactctcgtgtgcagcctctggattcaccttcagtagatatggcatgcactgggtccgccaggctccaggcaaggggctggagtgggtggcagtgatatcacatgatggaaataataaatactatgcagactccgtgaagggccgattcaccatctccagagacaattccaagaacacgctgtatctgcaaatgaacagcctgagaactgacgacacggctgtgtattactgtgcgaaagatccaagcagcatggcagcagcgagcggtatggacgtctggggccaagggaccacggtcaccgtctcctca

SEQ ID NO: 4422 - DNA, 318 bp, Homo sapiens
tcctttgagctgactcagccaccctcagtgtccgtgtccccaggacagacagccagcatcacctgctctggagataatttggggagtaaatatgcttgctggtatcagcagaagccaggccagtcccctgtgctggtcatctatcaagatagccagcggccctcagggatccctggacgattctctggctccaactctgggaacacagccactctgaccatcagcgggacccaggctatcgatgaggctgactattactgtcaggcgtgggacagcagcgctgtggtattcggcggagggaccaagctgaccgtccta

SEQ ID NO: 4423 - DNA, 393 bp, Homo sapiens
gagacgcaactgttggagtctgggggaggcttgggacagcctggggggtccctgagactctcctgtgcagcctctggattcacctttagcacctatgccatgagctgggtccgccaggctccagggaaggggctggagtgggtctcagctattagtggtagtggtggtagtatatactacgcagactccgtgaagggccgggtcaccatctccagagacaattccaagaacacgctgtatctgcaaatggacagcctgagagccgaggacacggccatatattactgtgcgaaagatcaaccccatattagtatggttcagggagccggcgaaaggtggtggggatactcctttgactactggggccagggaaccctggtcaccgtctcctca

SEQ ID NO: 4424 - DNA, 336 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcactaagcggccctcaggggtttctaatcgcttctctggctccaagtctggcaacacggcctccctgacaatctctgggctccagtctgaggacgaggctgattattactgctgctcatatgcaggtagtagcacccgtccgtatgtcttcggaactgggaccaaggtcaccgtccta

SEQ ID NO: 4425 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaaataataaatactacgcagactccgtgaagggccgattcaccatctccagagacaattccaagaacacgctgtatctgcaaatgaacagccagagagctgaggacacggctgtatattactgtgcgagaccacatagtgggagctacagttcctttattgactactggggccagggaaccctggtcaccgtctcctca

SEQ ID NO: 4426 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcattggcagtgggtctgggacagacttcactctcactatcaacagactggagcctgaagattttgcagtgtattactgtcaccagtatgataggtcacctcggctcactttcggcggagggaccaaggtggagatcaaa

SEQ ID NO: 4427 - DNA, 363 bp, Homo sapiens
caggtgcagctggtggagtctgggggaggcgtggtccagcctgggaggtccctgagactcccctgtgcagcctctggattcaccttcaatatctatgctatgcactgggtccgccaggctccaggcaaggggctggagtgggtggcagttatatcatatgatggaattaataaatactatgcagacgccgtgaagggccgattcaccatctccagagacaattccaagaacacgctgtatctgcaaatgaacagcctgagacctgaggacacggctgtgtattactgtgcgaggtctcgaggtgggaactactacgccggctttgactactggggccagggaaccctagtcaccgtctcctca

SEQ ID NO: 4428 - DNA, 333 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaaatctggcaacacggcctccctgaccatctctgggctccaggctgaggacgaggctacctattactgcagctcatatacaagcagcagcgccccttatgtcttcggaactgggaccaaggtcaccgtccta

SEQ ID NO: 4429 - DNA, 363 bp, Homo sapiens
caggtgcagctggtggagtctgggggaggcgtggtccagcctggggggtccctgacactctcctgtgcagcctctggattcaccttcagtagctatgctatgcactgggtccgccaggctccaggcaaggggctggagtgggtggcagttatttcatatgatggaattaatgaatactacgcagactccgtgaatggccgactcaccatctccagagacaattccaagaacacgctctatctgcaaacgaacagcctgagagctgaggacacggctgtctattactgtgcgaggtcaaagagtgggagctatttctacggtatggacgtctggggccaagggaccacggtcaccgtctcctca

SEQ ID NO: 4430 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaaactcctgatctataaggcgtctactttagaaagtggggtcccatcaaggttcagcggcagtggatctgggacagaattcactctcaccatcagcagcctgcagcctgatgattttgcaacttattactgccaacagtataatagttattcttggacgttcggccaagggaccaaggtggaaatcaaa

SEQ ID NO: 4431 - DNA, 378 bp, Homo sapiens
caggtgcagctggtggagtctgggggaggcgtggtccagcctgggaggtccctgagactctcctgtgcagcctctggattcaccttcagtagttatcctatgcactgggtccgccaggctccaggcaaggggctggagtgggtgacacttatatcatatgatggaagtaataaatactacgcagactccgtgaagggccgattcaccatctccagagacaattccaggaacacgctgtatctgcaaatgaacagcctgagagctgaggacacggctgtgtattactgtgcgagagattatgttgtaatggtggtggcggactacttccactacggtatggacgtctggggccaagggaccacggtcaccgtctcctca

SEQ ID NO: 4432 - DNA, 348 bp, Homo sapiens
caggctgtgctgactcagccgtcttccctctctgcatctcctggagcatcagccagtctcacctgcaccttacgcagtggcatcaatgttggtacctacaggatatactggtaccagcagaagccagggagtcctccccagttcctcctgaggtacaaatcagactcagattaccagcggggctctggagtccccagccgcttctctggatccaaagatgcttcggccaatgcagggattttactcatctctgggctccagactgaggatgaggctgactattactgtatgatttggcacagcagcgcttctgcggtattcggcggagggaccaaactgaccgtccta

SEQ ID NO: 4433 - DNA, 336 bp, Homo sapiens
caggtgcagctgcaggagtcgggcccaggactggtgaagccttcggagaccctgtccctcacctgcactgtctctggtggctccatcagtagttactactggagctggatccggcagcccccagggaagggactggagtttattggatatatctattacagtgggagcaccaactacaacccctccctcaagagtcgagtcaccatatcagtggacacgtccaagaaccagttctccctgaagctgacctctgtgaccgctgcggacacggccgtgtattactgtgcgagaggctttgactactggggccagggaaccctggtcaccgtctcctca

SEQ ID NO: 4434 - DNA, 324 bp, Homo sapiens
gaaattgtgttgacgcagtctccaggcaccctgtctttgtctccaggggaaagagccaccctctcctgcagggccagtcagagtattagtagcatctacttaggctggtaccagcagaaacctggccaggctcccaggctcctcatctatggtgcatctagcagggccattggcatcccagacaggttcagtggcagtgggtctgggacagacttcactctcaccatcagcagactggagcctgaagattttgcagtgtattactgtcagcaatatggtagctcaccgtggacgttcggccaagggaccaaggtggaaatcaaa

SEQ ID NO: 4435 - DNA, 372 bp, Homo sapiens
gaggtccagctggtacagtctgcggctgaggtgaagaagcctgggactacactgaaaatctcctgcaaggtttctggatacaccttcatcgacttttacatgcactgggtgcaacaggcccctggaaaagggcttgagtggatgggacttgttgatcctgaagacggtgaaacaatatacgcagagaagttccagggcagagtcaccataaccgcggacacgtcttcagacacagcctacatggagctgagcagcctgagatctgaggacacggccgtgtattactgtgcaacagatacgtcccttggaatgactacagtaactacggactcccgcaaatggggccagggaaccctggtcaccgtctcctca

SEQ ID NO: 4436 - DNA, 336 bp, Homo sapiens
gatattgtgatgacccagactccactctcctcacctgtcacccttggacagccggcctccatctcctgcaggtctagtcaaagcctcgtacacagtgatggaaacacctacctgagttggcttcagcagaggccaggccagcctccaagactcctaatttacaaggtttctaaccgattctcgggggtcccagacagattcagtggcagtggggcagggacagatttcacactgaaaatcagcagggtggaagttgaggatgtcggcatttattactgcatgcaagctacacaatttccgctcactttcggcggagggaccaaggtggagatcaag

SEQ ID NO: 4437 - DNA, 369 bp, Homo sapiens
caggtccagttggtacagtctggggctgaggtgaagaagcctggggcctcagtgaaggtctcctgcaaggtttccggatacaccctcgttgaattatccatatactgggtgcgacaggctcctggaaaagggcttgagtggatgggaggttttgatcctgataaaggtgaaacaatctacgcacagaagttccagggcagagtcaccatgaccgaggacacatctacagacacagcctacatggagctgagcagcctgagatctgaggacacggccgtgtattactgtacagctacagcccctacttctatagcagccaagaactggttcgacccctggggccagggaaccctggtcaccgtctcctca

SEQ ID NO: 4438 - DNA, 330 bp, Homo sapiens
cagtctgtgttgacgcagccgccctcagtgtctgcggccccaggacagaaggtcaccatctcctgctctggaagcagctccaacattgggaataattatgtatcctggtatcagcagttcccaggaacagcccccaaactcgtcatttatgacaacaataagcgaccctcagggattcctgaccgattctctggctccaagtctggcacgtcagccaccctgggcatcaccggactccagactggggacgaggccgattattactgcggaacatgggacagcagcctgagtgctgtggttttcggcggagggaccaagctgaccgtccta

SEQ ID NO: 4439 - DNA, 366 bp, Homo sapiens
caggtacagctgcaggagtcgggcccaggactggtgaagccttcggacaccctgtccctcacctgcactgtctctggttactccatcagcaatagtaactggtggggctggatccggcagcccccagggaagggactggagtggattgggtacatctattatagtgagagcccctactacaacccgtccctcatgagtcgactcaccatgtcagtagacacgtccaagaaccagttctccctgaagctgagctctgtgacggccgtggacacggccgtgtattattgtgcgagaacgcaggcgtatagcagcagattccgtgcttttgatatctggggccaagggacaatggtctccgtctcttca

SEQ ID NO: 4440 - DNA, 318 bp, Homo sapiens
tcctatgaggtgacgcagccacgctcagtgtccgtgtccccaggacagacagccagcatcacctgctctggagataaattgggggataaaaattcctgttggtatcagcagaagccaggccagtcccctgtgttggtcatctatcaagagaccacgcggccctcagggatccctgagcgattctctggctccatctctgggaacacagccactctgaccatcagcgggacccaggctatggatgaggctgactattactgtcaggcgtgggacagcggcattgtggtattcggcggagggaccaagctgaccgtccta

SEQ ID NO: 4441 - DNA, 363 bp, Homo sapiens
caggtgcagctacagcagtggggcgcaggactgttgaagccttcggagaccctgtccctcacctgcgctgtctatggtgggtccttcagtaattactattggacttggatccgccagcccccagggaaggggctggagtggattggggaaatcaatcatagtggaagcaccaactacaacccgtctctcaagagtcgagtcaccatatcggtagacacgtccaagaaccacttctccctgaaagtgaactctgtgaccgccgcggacacggctgtgtatttctgtgcgagaggctgggggagcagcacctggtatcagatttttgactattggggccagggaatccaggtcaccgtctcctca

SEQ ID NO: 4442 - DNA, 330 bp, Homo sapiens
cggtctgccctgactcagcctgcctccgtgtctgggtctcctggacagtcgatcaccatctcctgcactggaaccagcggtgatgttgggagttataaccttgtctcctggtaccaacagcacccaggcaaagcccccaaactcatgatttatgagggccttaagcggccctcaggggtttctgatcgcttctctggctccaagtctggcaacacggcctccctgacaatctctgggctccaggctgaggacgaggctgattattactgctactcctatgcaggtagtagcacttgggtattcggcggagggaccaaactgaccgtccta

SEQ ID NO: 4443 - DNA, 357 bp, Homo sapiens
gaggtgcagctgttggagtctgggggaggcttggtccagcctggggggtccctgagactctcctgtgcagcctctggattcatatttagcggctatgccatgagctgggtccgccaggctccagggaaggggctggagtgggtctcagctattagtggtagtagtagtgctatatactacacagactccgtgaggggccggttcaccatctccagagacaattccaagaacacgctgtatctgcaaatgaacagcctgagagccgaggacacggccgtgtattactgtgcgaaagatccgaatggtgtcctttactttgactactggggccagggagccctggtcaccgtctcctca

SEQ ID NO: 4444 - DNA, 318 bp, Homo sapiens
gacatccagatgacccagtctccttccaccctgtctgcatctgtaggagacagagtcaccatcacttgccgggccagtcagagtattagtagttggttggcctggtatcagcagaaaccggggaaagcccctaacctcctgatctatgaggcgtctagtttagaaagtggggtcccgtcaaggttcagcggcagtggatctgggacagaattcactctcaccatcagcagcctgcagcctgatgattttgcaacttattactgccaacagtatagtacttattccaccttcggccaagggacacgactggagattaaa

SEQ ID NO: 4445 - DNA, 381 bp, Homo sapiens
cagctgcagctgcaggagtcgggcccaggactggtgaagccttcggagaccctgtccctcacctgcactgtctctggtggctccatcagcagtagtcgtcactactggggctggatccgccaggccccagggaaggggctggagtggattgggagtatgttttacagtgcgagcacctactacaatccgtccctccagagtcgagtcagcatattcgaagacacatccaagaatcaattctccctgaagttgagctctgtgaccgccgcagacacggctgtctattactgtgcgagactggaatttggattattatggttcggggagttctcagacgcttctgatatctggggccaagggacaatggtcaccgtctcttca

SEQ ID NO: 4446 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctctcactttcggcggagggaccaaggtggagatcaaa

SEQ ID NO: 4447 - DNA, 366 bp, Homo sapiens
caggtgcagctggtgcaatctgggtctgagttgaagaagcctggggcctcagtgaaggtttcctgccaggcctctgggtacaccttcacaaatcatgctatgaattgggtgcgacaggcccctggacaggggcttgagtggatgggatggatcaacaccaacactgggaacccaacatatgcccagggcttcacaggacggtttgtcttctctttggacacctctgtcaccacggcatatctgcagatcaccagcctaaaggctgaggacactgccttttattactgtgcgagagcgtctgcgcgtccgggtgttgcaaccaactttgacttctggggccagggaaccctggtcgtcgtctcgtca

SEQ ID NO: 4448 - DNA, 321 bp, Homo sapiens
gacatccagatgacccagtctccatcctccctgtctgcatctgtaggagacagagtcaccatcacttgccgggcaagtcagagcattgacaactatttaaattggtatcagcagaaaccagggaaagcccctaacctcctgatctatgctgcatccagtttgcatagtggggtcccatcaaggttcagtggcagtggatctgggacagattttactctcatcatcagcagtctacaacctgaagatcttgcaacttattactgtcaacagagttacagtaatcctctcactttcggccctgggaccaaagtggatatcaga

SEQ ID NO: 4449 - DNA, 378 bp, Homo sapiens
caggtgcagctgcaggagtcgggcccaggactggtgaagccttcacagaccctgtccctcacctgcactgtctctggtggctccatcagcagcggtgattactactggagttggatccggcagcccccagggaagggcctggaatggattgggtacatctattacagtgggttcacctactacaacccgtccctcaagagtcgagttaccatatcagtagacacgtccaagaaccaattctccctgaagctgagctctgtgactgccgcagacacggccgtgtattactgtgccagagagcacttggttcagggaacatctcccccctactttggctttgactactggggccagggaaccctggtcaccgtctcctca

SEQ ID NO: 4450 - DNA, 321 bp, Homo sapiens
gaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcatcatcagcagcctgcagtctgaagattttgctgtttattactgtcagcagtataataactggcctcggacgttcggccaagggaccaaggtggaaatcaaa

SEQ ID NO: 4451 - DNA, 378 bp, Homo sapiens
gaggtgcgcctgatggaatttgggggaggcttggtacagcctggggggtccctgagactctcctgtgcagcctctggattcaccttcagttactataacatgaactgggtccgccaggctccagggaaggggctggagtggatctcatacattagtagtagtagtaataccattaactacgcagactctgtgaagggccgattcaccatctccagagacaatggcaagaactcactgtatctgcaaatgaacagcctaagagacgaggacacgggtgtgtattactgtgcgagagactcttacgaagttttgactggttttaattcaatacctccctttgactactggggccagggagccctggtcaccgtctcctca

SEQ ID NO: 4452 - DNA, 321 bp, Homo sapiens
gacatccagatgacccagtctccatcctccctgtctgcatttgtaggagacagagtcaccatcacttgccgggcaagtcagggcattagaaatgatttaggctggtatcagcagaaaccagggaaagcccctaagcgcctgatctatgctgcatccagtttgcaaagtggggtcccatcaaggttcagcggcagtggatctgggacagaattcactctcacaatcagcagcctgcagcctgaagattttgcaacttattactgtctacagtataatagttaccctatcaccttcggccaagggacacgactggagattaaa

SEQ ID NO: 4453 - DNA, 363 bp, Homo sapiens
caggtgcagctggtggagtctgggggaggcgtggtccagcctgggaggtccctgagactctcctgtgcagcctctggattcaccttcagtacctatgctatgcactgggtccgccaggctccaggcaaggggctggagtgggtggcagttatatcatatgatggaattaataaatactacgcagactccgtgaagggccgattcaccatctccagagacaattccaagaacacgctgtatctgcaaatgaacagcctgagatctgaggacacggctgtatattactgtgcgagagcgctaggggggggctactaccacggtatggacgtctggggccaagggaccacggtcaccgtctcctca

SEQ ID NO: 4454 - DNA, 333 bp, Homo sapiens
cagtctgccctgactcagcctgcctccgtgtctgggtctcctggacagtcgatcaccatctcctgcactggaaccagcagtgacgttggtgattataactatgtctcctggtaccaacaacacccaggcaaagcccccaaactcatgatttatgatgtcagtaatcggccctcaggggtttctaatcgcttctctggctccaagtctgccaacacggcctccctgaccatctctgggctccaggctgaggacgaggctgattattactgcacctcatatacaagcagcagcactctttatgtcttcggaactgggaccaaggtcaccgtccta

SEQ ID NO: 4455 - DNA, 366 bp, Homo sapiens
caggtgcagctggtggagtctgggggaggcgtggtccagcctgggaagtccctgagactctcctgtgcaggctctggattcaccttcagtagttatgctatgcactgggtccgccaggctccaggcaaggggctggagtgggtggcagttatatcatatgatggaagtaataaatactacgcatactccgtgaagggccgattcaccatctccagagacaattccaagaacacgctgtatctgcacatgaacagcctgcgagctgaggacacggctgtatattactgtgcgagaggttatcattcggggagttattatccactatatctctattggggccagggaaccctggtcaccgtctcctca

SEQ ID NO: 4456 - DNA, 318 bp, Homo sapiens
gacatccagatgacccagtctccttccaccctgtctgcatctgtaggagacagagtcaccatcacttgccgggccagtcagagtattagtaactggttggcctggtatcagcagaaaccagggaaagcccctaagctcctgatctatgaggcgtctagtttacaaagtggggtcccatcaaggttcagcggcagtggatctgggacagaattcactctcaccatcagcagcctgcagcctgatgattttgcaacttatttctgccaacattataatacttattccacttttggccaggggaccaagctggagatcaaa

SEQ ID NO: 4457 - DNA, 372 bp, Homo sapiens
gaggtgcagctggtggagtctgggggaggcttggtacagcctggggggtccctgagactctcctgtgcagcctctggattcacgttcagtagtcatagcatgaactgggtccgccaggctccaggaaaggggctggtgtgggtttcatacattagtactagtagtagtaccatatactacgcagactctgtgaagggccgattcaccatctccagagacaacgccaagaactcactgtatctgcaaatgaacagcctgagagccgaggacacggctgtgtattactgtgcgagagagaggagcggtgactacggcccatactattacggtatggacgtctggggccaagggaccacggtcagcgtctcctca

SEQ ID NO: 4458 - DNA, 321 bp, Homo sapiens
gacatccagatgacccagtctccatcctccctgtctgcatctgtcggagacagagtcaccatcacttgccgggctagtcagagcattagcagctatttaaattggtatcaccagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttattattgtcaacagagttacagtacccctcggacgttcggccaagggaccaaggtggaaatcaaa

SEQ ID NO: 4459 - DNA, 363 bp, Homo sapiens
caggtgcagctggtggagtctgggggaggcgtggtccagcctgggaggtccctgagactctcctgtgcagcctctggattcaccttcagtatttatgctatgcactgggtccgccaggctccaggcaaggggctggagtggttggcacttatatcatatgatggaagtaataaatacttcgcagacgccgtgaggggccggttcaccatctccagagacaattccaagaacacgctgtatctgctaatgaacagcctgagagctgaggacacggctgtgtattactgtgcgagagccttagggggtacttacagtcacccctttgactactggggccagggatccctggtcaccgtctcctca

SEQ ID NO: 4460 - DNA, 321 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggcgcctgaagattttgcagtgtattactgtcagcagtatggtagcttgtacacttttggcctggggaccgagctggagatcaga

SEQ ID NO: 4461 - DNA, 369 bp, Homo sapiens
caggtgcagctggtgcagtctggggctgaggtgaagaagcctggggcctcagtgaaggtctcctgcaaggcttctggatacaccttcaccgcctactatatgcactgggtgcgacaggcccctggacaagggcttgagtggatgggctggatcaaccctaacagtgatgacacaaactatgcacagaagtttcagggcagggtcaccatgaccagggacacgtccatcagtacagcctacatggagctgagcaggctgagatctgacgacacggccgtctattactgtgcgagggaagagggagtcttcacaatcggggaccgatacttcgatctatggggccgtggcaccctggtcagtgtctcctca

SEQ ID NO: 4462 - DNA, 330 bp, Homo sapiens
cagactgtggtgacccaggagccatcgttctcagtgtcccctggagggacagtcactctcacttgtggcttgagctctggctcagtctctactagttactaccccagctggtaccagcagaccccaggccaggctccacgcacgctcatctacaacacaaacactcgctcttctggggtccctgatcgcttctctggctccatccttgggaacaaagctgccctcaccatcacgggggcccaggcagatgatgaatctgattattactgtgtgctttatatgggtagtggcatttgggtgttcggcggagggaccaagctgaccgtccta

SEQ ID NO: 4463 - DNA, 375 bp, Homo sapiens
gaggtgcagctgttggagtctgggggaggcttggtacagcctggggggtccctgagactctcctgtgcagcctctggattcacctttagtaactatgccatgagctgggtccgccaggctccagggaaggggctggagtgggtctcaggtattagtggtggtggtggtagtacatacgacgcagactccgtgaagggccggttcaccatctccagagacaattccaagaacacgctgtatctgcaaatgaacagcctgagagccgaggacacggccgtatattactgtgcgaaaggggactatatcagcagctggtacgtcccaccctacgatatggacgtctggggccaagggaccacggtcaccgtctcctca

SEQ ID NO: 4464 - DNA, 336 bp, Homo sapiens
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccaactttcggcggagggaccaaggtggagatcaaa

SEQ ID NO: 4465 - DNA, 369 bp, Homo sapiens
gaggtgcagctgttggagtctgggggaggcttggtacagccgggggggtccctgagactctcctgtgcagcctctggattcacctttagcaactatgccatgaactgggtccgccaggctccagggaaggggctggagtgggtctcagctattagtggtagtggtggtggcacatactacgcagactccgtgaagggccggttcaccatcttcagagacaattccaagaacactctgtatctgcaaatgatcagcgtgagagccgacgacacggccatttattactgtgcgcagattccgcccccccgtatggcggcagctgccatagtatattactggggccagggaaccctggtcaccgtctcctca

SEQ ID NO: 4466 - DNA, 330 bp, Homo sapiens
cagtctgtgctgactcagccaccctcagcgtctgggacccccggtcagagggtcaccatctcttgttctggaagcagctccaacatcggaagtaatactgtaaactggtaccagcagctcccaggaacggcccccaaactcctcatctatagtagtaatcagcggccctcaggggtccctgaccgattctctggctccaagtctggcacctcagcctccctggccatcagtgggctccagtctgtggatgaggctgattattactgtgcggcatgggatgacagcctgactggttatgtcttcggaactgggaccacggtcaccgtccta

SEQ ID NO: 4467 - DNA, 375 bp, Homo sapiens
caggtgcagctgcaggagtcgggcccaggactggtgaagccttcacagaccctgtctctcacctgcactgtctctggtggctccatcagcagtggtggttactactggagctggatccgccagcacccagggaagggcctggagtggattgggtacatctattacagtgggagcacgtactacaacccgtccctcaagagtcgagttaccatatcagtagacacgtctaagaaccagttctccctgaagctgagctctgtgaccgccgcggacacggccgtgtattactgtgcgactgaagggattactatgcttcgggcagttggctacggtttagacgtctggggccaagggaccacggtcaccgtctcctca

SEQ ID NO: 4468 - DNA, 330 bp, Homo sapiens
cagtctgccctgactcagcctgcctccgtgtctgggtctcctggacagtcgatcaccatctcctgcactggaaccagcagtgacgttggtcgttataactctgtctcctggtaccaacagcacccagacaaagcccccaaactcataatttatgaggtcactaatcggccctcaggggtttctaatcgcttctctggctccaagtctggcaacacggcctccctgaccatctctgggctccaggctgaggacgaggctgattatttctgctcctcatttacaaccatcagcactctcgtcttcggaactgggaccaaggtcaccgcccta

SEQ ID NO: 4469 - DNA, 360 bp, Homo sapiens
caggtgcagttggtggagtctgggggaggcgtggtccagcctgggaagtccctgagactctcctgtgcagcctctggattcaccttcggtagctatgctatccactgggtccgccaggctccaggcaaggggctggagtgggtggcagttatatcacatgatggaagtaagaagtactacgcagactccgtgaagggccgattcaccatctccagagacaagtccaagaacacgctgtatctgcaaatgaacagcctgagagctgaggacacggctgtgtatcactgtgcgagagatagcgagtcggtggctggtccacttgactactggggccagggaaccctggtcaccgtctcctca

SEQ ID NO: 4470 - DNA, 318 bp, Homo sapiens
tcctatgagctgactcagccaccctcagtgtccgtgtccccaggacagacagccagcatcacctgctctggaggtaaattggactataaatatgcttattggtatcagcagaagccaggccagtcccctgtgttggtcatctatcaagataccaagcggccctcagggatccctgagcgattctctggctccagctctgggaacacagccactctgaccatcagcgagacccaggctatggacgaggctgactattactgtcaggcgtgggacagcaacactgtggtgttcggcggagggaccaaggtgaccgtccta

SEQ ID NO: 4471 - DNA, 369 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttgtgtcatacgatggaaattataaaaactacgcagactccgtgaagggccgcctcaccatctccagagacaattcgaagaacacgctgtatctgcaaatgaacagcctgagactggaggacacggctgtctattactgtgcgagagatagcattactatggttcggggaaatagctggttcgacccctggggccagggaaccctggtcaccgtctcctca

SEQ ID NO: 4472 - DNA, 324 bp, Homo sapiens
gaaattgtgttgacgcagtctccagccaccctgtctttgtctccaggggaaagagccaccctctcctgcggggccagtcagagtgttaccagcaactacttagcctggtaccagcagaaacctggcctggcgcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcaccgctcactttcggcggagggaccaaggtggagatcaaa

SEQ ID NO: 4473 - DNA, 372 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatgtaagtaataaatactatgcagactccgtgaagggccgattcaccatctccagagacaattccaagaacacgctgtatctgcaaatgaacagcctgagagtagaggacacggctgtgtattactgtgcgaaagcgggggggggttatagcagcagctggttggggatttttggatactggggccagggaaccctggtcaccgtctcctca

SEQ ID NO: 4474 - DNA, 342 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcctctattcactttcggccctgggaccaaagtggatatcaaa

SEQ ID NO: 4475 - DNA, 363 bp, Homo sapiens
caggtgcacctggtgcagtctgggggaggcgtcgtccagcctgggaagtccctgacaatctcctgtgcagcgtctggattcgatttcagaacgtatggcatgcactgggtccgccaggctccaggcaagggcctggaatgggtggcaaatgtctggattgatggaacaaacacatattatgcagactccgtgaggggccgattcaccatctctagagacgattcaaagagtatcctgtctctgcaaatggacagcctgacaggcgacgacacggctgtttattactgtgcgagggcggactggccgggacacggggccggtgtggacgtctggggccaagggaccacggtcatcgtctccgca

SEQ ID NO: 4476 - DNA, 321 bp, Homo sapiens
gacatccagatgacccagtctccatcctccctgtctgcatctatcggagacagagtcaccatcacttgccgggcgagtcggcccattaacacttatttagcctggtatcagcaaagaccagggaaagttcctaagctcctgatcaatggtgcatccactttgcaatcgggggtcccatctcggtttcgtggcagtggatctgggacagatttcactctcaccatcagcagcctgcagcctgaagatgttgcaacttattactgtcagaggtataacggtcccccattcgctttcggccctgggaccaaagtggatctcaag

SEQ ID NO: 4477 - DNA, 357 bp, Homo sapiens
caggtgcagctacagcagtggggcgcaggactgttgaagccttcggagaccctgtccctcacctgcgctgtctatggtgtgtccttcagaggttattactggagctggatccgccagcccccagggaaggggctggagtggattggggaaatcaatcatagtggaagcaccaactacaacccgtccctcaagagtcgagtcaccatatcagtagacacgtccaagaaccaggtctccctgaagttgagctctgtgaccgccgcggacacggctgtcttttactgtgcgagaggcggtggatacagctatggagccattgactactggggccagggaaccctggtcaccgtctcctca

SEQ ID NO: 4478 - DNA, 333 bp, Homo sapiens
cagtctgtgctgactcagccagcctcagcgtctgggacccccgggcagagggtcaccatctcttgttctggaagcagctccaacatcggaatcaattatgtatactggtatcagcagctcccaggaacggcccccaaactcctcatctataggaataatcagaggccctcaggggtccctgaccgattctctggctccaagtctggcacctcagcctccctggccgtcagtgggctccggtccgaggatgaggctgattattactgtgcagcatgggatgacagcctgagtggccatgtggttttcggcggagggaccaagctgaccgtccta

SEQ ID NO: 4479 - DNA, 360 bp, Homo sapiens
caggtgcagctgcaggagtcgggcccaggactggtgaagccttcacagaccctgtccctcacctgcactgtctccggtggctccatcagcagtggtgcttactactggaactggatccgccagcacccagggaagggcctggagtggattgggaacatctattacagtgggggcacctactacaagccgtccctcaagagtcgagttaccatatcagtagacacgtctaagaaccagttctccctgaagctgagctctgtgactgccgcggacacggccgtgtattactgtgcgagacaaatgtggttacggggtgcttttgatatctggggccaagggacaatggtcaccgtctcttca

SEQ ID NO: 4480 - DNA, 330 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatgtgttattcggcggagggaccaagctgaccgtccta

SEQ ID NO: 4481 - DNA, 372 bp, Homo sapiens
gaggtgcagctggtggagtctgggggaggcttggttcagcctggggggtccctgagactctcctgtgcagcctctggattcaccttcagtacctatagcatgaactgggtccgccaggctccagggaaggggctggagtgggtttcatacatcagtaaaagtagtagtaccaaatacgacgcagactctgtgaagggccgattcaccatctccagagacgatgccaagaacacactgtatctgcaaatggacagcctgagagacgaggacacggctgtgtattactgtgcgaggcaccatggttcgggtctctcatactactactacggtctggacgtctggggacaagggaccacggtcaccgtctcctca

SEQ ID NO: 4482 - DNA, 321 bp, Homo sapiens
gacatccagatgacccagtctccatcctccctgtctgcatctgtgggagacagagtcaccatcacttgccgggcaagtcagaacatttacagctatttaagttggtatcagcagaaaccagggaaagcccctaagctcctgatctatgccgcttccagtttgcaaagtggggtcccatcaaggttcagtggcagtggatctgggacagatttcactctcaccatcagcagtctgcaacctgaagattttgcaacttactactgtcaacagagttacagtacccctccaacgttcgcccaagggaccaaggtggaaatcaaa

SEQ ID NO: 4483 - DNA, 357 bp, Homo sapiens
gaggtgcagctgttggagtctgggggaggcttggtacagcctggggggtccctgagactctcctgtgcagcctctggattcacctttagcagctatgccatgacctgggtccgccaggctccagggaaggggctggagtgggtctcagctattagtgctactggtggtagcacattctacgcagactccgtgaagggccggttcaccatctccagagacaattccaagaacacgctgtatctgcaaatgaacagcctgagagccgaggacacggccgtatattactgtgcgaaaccatactacggctcgggtgcttttgatatctggggccaagggacaatggtcaccgtctcttca

SEQ ID NO: 4484 - DNA, 345 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagttgctcatttactgggcatctacccgggaatccggggtccctgaccgattcagtggcagcgggtctgggacagatttcactctcaccatcagcagcctgcaggctgaagatgtggcagtttattactgtcagcaatattatagtactccccctatgtacacttttggccaggggaccaagctggagatcaaa

SEQ ID NO: 4485 - DNA, 393 bp, Homo sapiens
gaggagcagctggtggagtctgggggaggcttggtccagcctggggggtccctgagactctcctgtgcagcctctggattcacctttagtcactattggatgacctgggtccgccaggctccagggaaggggctgaagtgggtggccaacataagggaggatggaagtgagaaacactacgtggactctgtgaagggccgattcaccatctccagagacaacgccaagaacttagtctatctgcaaatgaacaccctgagagccgaggacacggctgtgtattactgtgcgagagagcgagtcctcctaggacagtgtagtggtgataactgctacaccaaaagaaactggttcgacccctggggcccgggaaccctggtcaccgtctcctca

SEQ ID NO: 4486 - DNA, 330 bp, Homo sapiens
gaaattgtgttgacacagtctccagccaccctgtctttgtctccaggcgaaggagccaccctctcctgcagggccagtcagagtgttagcagctacttagcctggtaccaacacaaacctggccaggctcccaggctcctcatctatgatgcatccaacagggccactggcatccctcccaggttcagtggcagtgggtctgggacagacttcactctcaccatcagcagcctagagcctgaagattttgcagtttattactgtcagcagcgtagcaactggcctccggaggggctcactttcggcggagggaccaaggtggaggtcaaa

SEQ ID NO: 4487 - DNA, 366 bp, Homo sapiens
caggtgcagctggtgcagtctggggctgaggtgaagaagcctggggcctcagtgacggtttcctgcaaggcatctggatacaccttcaccaactactatatgcactgggtgcgacaggcccctggacaagggcttgagtggatgggaataatcaaccctagtggtgggagcacaggctacgcgcagaagttccagggcagagtcaccatgaccggtgacacgtccacgagtacagtctacatggagctgagaagcctgagatatgaagacacggccgtctattactgtgcgagagatggggctctaatacccgctggggccccggttgactactggggccagggaaccctggtcaccgtctcctca

SEQ ID NO: 4488 - DNA, 333 bp, Homo sapiens
cagtctgccctgactcagcctgcctccgtgtctgggtctcctggacagtcgatcaccatctcctgcactggaaccagcagtgacgttggtgattataactatgtctcctggtaccaacaacacccaggcaaagcccccaaactcatgatttatgatgtccgtcatcggccctcaggggtttctaatcgcttctctggctccaagtctggcaacacggcctccctgaccatctctgggctccaggctgaggacgaggctgattattactgcagctcaaaaagaagcagcaccactctttatgtcttcggcactgggaccaaggtcaccgtccta

SEQ ID NO: 4489 - DNA, 378 bp, Homo sapiens
gaggtgcagctggtgcagtctggagcagaggtgaaaaagcccggggagtctctgaagatctcctgtaagggttctggatacagctttaccaactactggatcggctgggtgcgccagatgcccgggaaaggcctggagtggatgggaatcatctatcctggtgactctgataccagatacaacccgtccttccaaggccaggtcaccatctcagccgacaggtccatcagcgccgcctacctgcagtggagcagcctgaaggcctcggacaccgccatctattactgtgcgagacaaaattggtattattatgggtcggggacaaaatacccgggtttggacgtctggggccaagggaccacggtcaccgtctcctca

SEQ ID NO: 4490 - DNA, 321 bp, Homo sapiens
gaaattgtgttgacgcagtctccagtcaccctgtctttgtctccaggggaaagagccaccctctcctgcagggccagtcagagtgttagctacaggtacttagcctggtaccagcagaaacctggccaggctcccaggctcctcatctacggtgcatccagcagggccactggcatcccagacaggttcagtggcagtgggtctgggacagacttcactctcaccatcagcagactggagcctgaagattttgcagtctattactgtcagcagtatggtagctcacctcggttcggccgagggaccaaggtggaaatcaaa

SEQ ID NO: 4491 - DNA, 354 bp, Homo sapiens
caggtgcagctgcaggagtcgggcccaggactggtgaagccttcggagaccctgtccctcacctgcactgtctctggtggctccatcagtagttactactggagctggatccggcagtcccccgggaaggtactggagtggattgggtatatcacttacagtgggagcacaaactacaacccctccctcaagagacgagtcaccatatcagtagacacgtccaagaaccagttctccctgaagctgaggtctgtgaccgttgcggacacggccgtgtattactgtacggggggcgagtaccagccttaccagattgataattggggccagggaaccctggtcaccgtctcctca

SEQ ID NO: 4492 - DNA, 318 bp, Homo sapiens
tcctatgagctgactcagccaccctcagtgtccgtgtccccaggacagacagccagcatcacctgctctggagataaattggaaaataaatatgcttgctggtatcagcagaagccaggccagtcccctgtgctggtcatctatcaagataacaagcggccctcagggatccctgagcgattctctggctccaactctgggaacacagccactctgaccatcagcgggacccaggctatggatgaggctgactattactgtcaggcgtgggacagcaacactgtgattttcggcggagggaccaaactgaccgtccta

SEQ ID NO: 4493 - DNA, 360 bp, Homo sapiens
caggtgcagctggtggaatctgggggaggcgtggtccagcctgggaggtccctgagactctcctgtgcagcctctggattcaccttcagtacctatgctatgcactggttccgccaggctccgggcaaggggctggactgggtggcagttatatcatatgatggaagcaataaatattacgcagactccgtgaagggccgattcaccatctccagagacaattccaagaacacggtgtatctgcaaatgaacagcctgagagctgaggacacggctgtgtattactgtgcgagagatcagggtgtcatgaaatacggtatggacgtctggggccaagggaccacggtcaccgtctcctca

SEQ ID NO: 4494 - DNA, 324 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaatcgacagcctgcagcctgaagattttgcaacttattactgtcaacaacttaatagttcccccctattcactttcggccctgggaccaaagtggatatcaaa

SEQ ID NO: 4495 - DNA, 381 bp, Homo sapiens
caggtgcagctgcaggagtcgggcccaggactggtgaagccttcacagaccctgtccctcacctgcactgtctctggtggctccatcagcagtggtagttactactggagttggatccggcagcccgccgggaagggactggagtggattgggcgtatctatactagtgggagcaccaactacaacccctccctcaagagtcgagtcaccatatcagtagacacgtccaagaatcagttctccctgaagctgagctctgtcaccgccgcagacacggccgtatattactgtgcgagagaagaatattgtagtggtgatagctgctcccgggccaactggttcgacccctggggccagggaaccctggtcaccgtctcctca

SEQ ID NO: 4496 - DNA, 333 bp, Homo sapiens
cagtctgtgctgacgcagccgccctcaatgtctggggccccagggcagagggtcaccatctcctgcactgggagcagctccaacctcggggcaggttatcatgtacactggtaccagcagcttccagggacagcccccaaactcctcatctacagtaacaacaatcggccctcaggggtccctgaccgattctctggctccaagtctggcacctcagcctccctggccatcactgggctccaggctgaggatgaggctgattattactgccagtcctatgacagcagcctgagtgacgtgttattcggcggagggaccaagctgaccgtccta

SEQ ID NO: 4497 - DNA, 387 bp, Homo sapiens
caggtccagcttgtgcagtctggggctgaggtgaagaagtctggggcctcagtgaaagtttcctgcaaggcttctggatacaccttcagtggctacgctatacattgggtgcgccaggcccccggacaaaggcttgagtggatgggatggatcaacgcaggcaatggcaacacaaaatattcacagaagttccagggcagagtcaccattaccagggacacatccgccaacacagcctatatggagctgagcagcctgagatctgaagacacggctgtatatttctgtgcgaggggagaatgggtgggaatatattgtgatggtgattgctttgaactcgcctggttcgacccctggggccagggaaccctggtcaccgtctcctca

SEQ ID NO: 4498 - DNA, 324 bp, Homo sapiens
gaaatagtgatgacgcagtctccagccaccctgtctgtgtctccaggggaaagagccaccctctcctgcagggccagtcggagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctccgctcactttcggcggagggaccaaggtggagatcaaa

SEQ ID NO: 4499 - DNA, 360 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatttgatggaagcaataaatacaacgcagactccgtaaagggccgattcaccatctccagagacaattccaagaaaacgctgtatctgcaaatgaacagactgagagctgaggacacgggtgtgtattactgtgcgagagacccgaatgcagtgactggcccacttgactactggggccagggaaccctggtcaccgtctcctca

SEQ ID NO: 4500 - DNA, 318 bp, Homo sapiens
tcctatgaactgactcagccaccctcagtgtccgtgtccccaggacagacagccagcatcacctgctctggagataaattgggggataaatatgcttcctggtatcagcagaagccaggccagtcccctgtgctggtcatctatcaagatatcaagcggccctcagggatccctgagcgattctctggctccaactctgggaacacagccactctgaccatcagcgggacccaggctatggatgaggctgactattactgtcaggcgtgggccagcagcactgcggttttcggcggagggaccaagctgaccgtccta

SEQ ID NO: 4501 - DNA, 366 bp, Homo sapiens
gaagtgcagctggtggagtctgggggagtcgtggtacagcctggggggtccctgagactctcctgtgcagcctctggattcacctttgatgattataccatgcactgggtccgtcaagctccggggaagggtctggagtgggtctctcttattagttgggatggtgatagatcatactatgcagactctgtgaagggccgattcaccatctccagagacaacagcagaaactccctgtacctgcaaatgaacagtctgagaactgaggataccgccttgtattactgtgcaaaagcggatagccgcagctggtacacggatgcttttgatgtctggggccgagggacgatggtcaccgtctcttca

SEQ ID NO: 4502 - DNA, 330 bp, Homo sapiens
cagtctgtgctgactcagccaccctcagcgtctgggacccccgggcagagggtcaccatctcttgttctggaagcagctccaacatcggaaataatcctgtaaactggtaccagcagctcccaggaacggcccccaaactcctcatttataataataatcagcggccctcaggggtccctgaccgattctctggctcccagtctggcacctcagcctccctggccatcagtgggctccagtctgaggatgaggctgaatattactgtgcagcatgggatgacagcctgaatggtcgggtgttcggcggagggaccaagctgaccgtccta

SEQ ID NO: 4503 - DNA, 387 bp, Homo sapiens
gaggtgcagctggtggagtctgggggaggcttggtccagcctggggggtccctgagactctcctgtgcagcctctagattcacgtttagtagctattggatgagctgggtccgccaggctccagggaaggggctggagtgggtggccaacataaagcaagatggaagtgagaaatactatgtggactctgtgaagggccgattcaccatctccagagacaacgccaagaactcactgtatctgcaaatgaacagcctgagagccgaggacacggctgtgtattactgtgcgagagttagggtttactatgcttcggggagttatagttattactactactacactatggacgtctggggccaagggaccacggtcaccgtctcctca

SEQ ID NO: 4504 - DNA, 330 bp, Homo sapiens
gaaattgtgttgacgcagtctccaggcaccctgtctttgtctccaggggagagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctccccgattcactttcggccctgggaccaaagtggatatcaaa

SEQ ID NO: 4505 - DNA, 384 bp, Homo sapiens
caggaccagctcgtgcagtctggggctgaggtgaagaagcctgggtcctcggtgaaggtctcctgcaaggcttctggaggcaccttcagtagctatgctatcagctgggtgcgacaggcccctggacaagggcttgagtggatgggaaggatcatccctatccttgatgtagcaaactacgcacagaaattccagggcagagtcgcgattaccgcggacaaatccacgagcacagcctacatggagctgagcagcctgagatctgaggacacggccgtgtattactgtgcgagacctattcttgactacggtgactatatccgagactgggggcaatacggtatggacgtctggggccaagggaccacggtcaccgtctcctca

SEQ ID NO: 4506 - DNA, 336 bp, Homo sapiens
gatattgtgatgactcagtctccactgtccctgcccgtcacccctggagagccggcctccatctcctgcaggtctagtcagagcctcctccatagtaatggatacaaccatttggattggtacctgcagaagccagggcagtctccacagctcctgatctatttgagttctaagcgggcctccggggtccctgccaggttcagtggcagtggatccggcacagattttacactgaaaatcagcagagtggaggctgaggatgttggggtttattactgcatgcaagctctacaaactccgctcactttcggcggagggaccaaggtggagatcaaa

SEQ ID NO: 4507 - DNA, 363 bp, Homo sapiens
caggtgcagctggtggagtctgggggaggcgtggtccagcctgggaggtccctgagactctcctgtgcagcgtctggattcaccttcagtacctatggcatgcactgggtccgccaggctccaggcaaggggctggagtgggtggcagttatctggtatgatggaagtaataaacactataaagactccgtgaagggccgattcaccatctccagagacaactccaagaacacgctgtatctgcaactgaacagcctgagagccgaggacacggctgtgtattactgtgcgaaagatcggggcagtggctggtacggctactttgacgagtggggccagggaaccctggtcaccgtctcctca

SEQ ID NO: 4508 - DNA, 327 bp, Homo sapiens
gaaattgtgttgacgcagtctccaggcaccctgtctttgtctccaggggaaagagccaccctctcctgcagggccagtcagagggttggcagcagctacatagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtgcctcacctctgtacacttttggccaggggaccaagctggagatcaaa

SEQ ID NO: 4509 - DNA, 375 bp, Homo sapiens
gaggtgcagctgttggagtctgggggaggcttggtacagcctggggagtccctgagactctcctgtgcagcctctgcattcatctttaggagttatgccatgagctgggtccgccaggctccagggaaggggctggagtgggtctcagttattagtggcagtggtggtagaattacctacgcagactccgtgaagggccggttcaccatctccagagacaattccaagaacacgctgtatctgcaaatgaacagcctgagagccgaggacacggccgtatattactgtgcgaaatccttttttatgactacggtgactacgggggacggttcttttgattactggggccagggaaccctggtcaccgtctcctca

SEQ ID NO: 4510 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaccacccagacaaagcccccaaactcatgatttatgagctcagtaatcggccctcaggggtttctagtcgcttctctggctccaagtctggcaacacggcctccctgaccatctctgggctccaggctgaggacgaggctgattattactgcagctcatatacaagcagcagcacttatgtcttcggaactgggaccaaggtcaccgtccta

SEQ ID NO: 4511 - DNA, 336 bp, Homo sapiens
caggtgcagctgcaggagtcgggcccaggactggtgaagccttcggagaccctgtccctcacctgcactgtctctggtggctccatcagtaattactactggagctggatccggcagtccccagggaagggactggagtggattgggtatatctattacagtgggagcaccaactacaacccctccctcaagagtcgagtcaccatatcagtagacacgtccaagaaccagttctccctgaagctgaactctgtgaccgctgcggacacggccatatattactgtgcgagggggtttgactactggggccagggaaccctggtcaccgtctcctca

SEQ ID NO: 4512 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatgtttgctgcatccagcagggccattggcatcccagacaggttcagtggcagtgggtctgggacagacttcactctcaccatcagcagactggagcctgaagattttgcagtgtattactgtcagcagtatggtaactctccgtggacgttcggccaagggaccaaggtggaaatcaaa

SEQ ID NO: 4513 - DNA, 354 bp, Homo sapiens
caggtgcagctacaggagtcgggcccaggactggtgaagccttcggagaccctgtccctcacctgcactgtctctaatgactccattagtagttactattggagctggatccggcagcccgccgggaagggactggagtggattgggcgtgtttttgtcagtgggagcaccgactacaacccctccctcaagagtcgagtcaccatgtcagtagacacgtccaagaaccagttttccctgaagctgaggtctgtgacggccgcggacacggccgtgtattactgtgcgagagattccggtggctggcacgtctttgactactggggccagggaaccctggtcaccgtctcctca

SEQ ID NO: 4514 - DNA, 318 bp, Homo sapiens
tcctatgagctgactcagccaccctcagtgtccgtgtccccaggacagacagccagcatcacctgctctggagataaattggaaaataaatatgcttcctggtatcaccagaagccaggccagtcccctgtgctggtcatgtatcaagataccaagcggccctcagggatccctgagcgattctctggctccagctctgggaacacagccactctgaccatcagcgggacccaggttatggatgaggctgagtattattgtcaggcgtggggcagcaacactgtggttttcggcggagggaccaagctgaccgtccta

SEQ ID NO: 4515 - DNA, 369 bp, Homo sapiens
cagctgcagctgcaggagtcgggcccaggactggtgaagccttcggagaccctgtccctcacgtgcactgtctctggtggctccatcagcagtattaattactactggggctggatccgccagcccccagggaaggggctggagtggattgggagtatctattatagtgggatcacctactacaacccgtccctcgagagtcgagtcaccattttcgtagacacgtccaagaaccagttctccctgaagctgagctctgtgaccgccgcagacacggctgtgtattactgtgcgagggtgatagatacgttctactactccgatgttttggatgtctggggccaagggaccacggtcaccgtctcctca

SEQ ID NO: 4516 - DNA, 321 bp, Homo sapiens
gacatccagatgacccagtctccatctttcctgtctgcatctgtaggagacagagtcaccatcacttgccgggcaagtcagggcattagaaatgatttaggctggtatcagcagaaaccagggaaagtctttaagcgcctgatctatgctgcatccactttacaaagtggggtcccatcgaggttcagcggcagtggatctgggacacaattcactctcacaatcagcagcctgcagcctgaagattttgcaacttattactgtctacagcataatagttaccctctcactttcggcggagggaccaaggtggagatcaaa

SEQ ID NO: 4517 - DNA, 378 bp, Homo sapiens
gaggtgcagctggtggagtccgggggaggcttggtccagcggggggggtccctgaaactctcctgtgcagcctctgggttcatcttcagtggctctgctatgcactgggtccgccaggcttccgggaaagggctggagtgggttggccgtattagaatcaaagctgacaattacgcgacagcgtatgctgcgtcggtgaaaggcaggttcaccatctccagagatgattcaaggaccacggcgtatctgcaaatgaacagcctaaaaaccgaggacacggccgtgtattactgttgttccgctatggggataagggccgctgctatgaactggtacttcgatctctggggccgtggcaccctggtcactgtctcctca

SEQ ID NO: 4518 - DNA, 321 bp, Homo sapiens
gacatccagatgacccagtctccatcctccctgtctgcatctgttggagacagagtcaccatcacttgccgggcaggtcagagcattagcagctatttgaattggtatcagcagaaaccagggaaagcccctaagctcctgatctatattgcatccagtttacaaagtggggtcccatcaaggttcagtggcagtggatctgggacagatttcactctcaccatcagcagtctgcaacctgaagattttgcaacttactactgtcaacagagttacagtacccctcccacttttggccaggggaccaagctggagatcaaa

SEQ ID NO: 4519 - DNA, 372 bp, Homo sapiens
caggtgcagctgcaggagtcgggcccaggactggtgaagccttcacagaccctgtccctcacctgcagtgtctctggtggctccatcagcagtggtggttactactggagctggatccgccagcacccagggaagggcctggagtggattgggtacatctcttacagtgggagcacctactacaacccgtccctcaagagtcgagttaccatgtcagtagacacgtctaagaaccagttctccctgaagctgagctctgtgactgccgcggacacggccgtgtattactgtgctagattcaattacggtgttttgactggtcgacaacagttcgatctctggggccgtggcaccctggtcactgtctcctca

SEQ ID NO: 4520 - DNA, 333 bp, Homo sapiens
cagtctgtgttgacgcagccgccctcattgtctgcggccccaggacagaacgtcaccatctcctgctctggaagcagctccaacattgggaagaattatgtatcctggtaccagcaggttccagggacagcccccaaactcctcatttatgacaataaaaagcgaccctcagggattcctgaccgattctctggctccaagtctggcacgtcagccaccctgggcatcaccggactccagactggggacgaggccgattattactgcggaacatgggatgccaggctggatgctttctgggtgttcggcggagggaccaagctgaccgtccta

SEQ ID NO: 4521 - DNA, 381 bp, Homo sapiens
cacctgcagctgcaggagtcgggcccaggactactgaagccttcggaaaccctgtccctcacctgcactgtctctggtggatccatcaggagtagtagttactactggggctggatccgccagcccccagggaaggggctggagtggattgggagtatctattatagtgggagcacctactacaacccgtccctcaagagtcgagtcaccgtatcagtggacacgcccaagaaccagttctccctgaagctgaggtctctgaccgccgcggacacggccgtgtattactgtgcgggggagagtttacgatttttggagaggccattatccgcctacggcatggacgtctggggccaagggaccacggtcaccgtctcctca

SEQ ID NO: 4522 - DNA, 330 bp, Homo sapiens
cagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcttgatttatgatgtcactagtcggccctcaggggtttctaatcgcttctctggctccaagtctggcaacacggcctccctgaccatctctgggctccaggctgaggacgcggctgattattactgcagctcttttacaagcatcagcaccgtggttttcggcggagggaccaagctgaccgtccta

SEQ ID NO: 4523 - DNA, 360 bp, Homo sapiens
caggtgcagctggtggagtctgggggaggcgtggtccagcctgggaggtccctgagactctcctgtgcagcctctggattcaccttcagtggctatggcatgcactgggtccgccaggctccaggcaaggggctggagtgggtggcagttatatcatatgatggaagttataaatactatgcagactccgtgaagggccgattcaccatctccagagacaattccaagaacacgctgtatctgcaaatgaacagcctgagagctgaggacacggctgtttattactgtgcgaaagactacggtgactacgttacctggttcgacccctggggccagggaaccctggtcaccgtctcctca

SEQ ID NO: 4524 - DNA, 324 bp, Homo sapiens
gacatccagatgacccagtctccatcctccctgtctgcatctgtaggagacagagtcaccatcacttgccgggcaagtcagagcattagcacctatttaaattggtatcagcagaaaccagggaaagcccctaaactcctgatctatgctgcatccagtttgcaaagtggggtcccatcaaggttcagtggcagtggatctgggacagatttcactctcaccatcagcagtctgcaacctggagattttgcaacttacttctgtcaacagagttacagtacccccccgtggacgttcggccaagggaccaaggtggaagtcaaa

SEQ ID NO: 4525 - DNA, 384 bp, Homo sapiens
caggtcaccttgaaggagtctggtcctgtgctggtgaaacccacagagaccctcacgctgacctgcaccgtctctgggttctcactcatcaatgctagaatgggtgtgagctggatccgtcagcccccagggaaggccctggagtggcttgcccacattttatcgagtgacgaaaaatcctacagcacatctctgaagagcaggctcaccatctccaaggacacctccaaaagccaggtggtccttaccatgaccaacatggaccctgtggacacagccacatattactgtgcacggaatcactatagcagcagcccttaccggggaccttttgactggtacttcgatctctggggccgtggcaccctggtcactgtctcctca

SEQ ID NO: 4526 - DNA, 321 bp, Homo sapiens
tcctatgtgctgacccagccaccctcagtgtcagtggccccaggaaagacggccaggattacctgtgggggaaacaacattggaagtaaaagtgtgcactggtaccagcagaagccagcccaggcccctgtgctggtcatcaattatgataacgaccggccctcagggatccctgagcgattctctggctccaagtctgggaacacggccaccctgaccatcagcagggtcgaagccggggatgaggccgactattactgtcaggtgtgggatagaagtagtgatcatgtcttcggaactgggaccaaggtcaccgtccta

SEQ ID NO: 4527 - DNA, 360 bp, Homo sapiens
caggtgcagctggtggagtctgggggaggcgtggtccagcctgggaggtccctgagactctcctgtgcagcctctggttttaacctcagcaactatgctatgcactgggtccgccaggcatcaggcaaggggctggagtgggtgtcacttatatcatatgatggaaggattaaatattacacagactccgtgaagggccgattcaccgtctccggggacaattccaagaacacactgtttctgcaaatgaacagcctgcgagctgacgactcggctctttattactgtgtgaggggcggtgtcagtggcccaaattcttttgacatgtggggccaagggacaacggtcaccgtctcttcg

SEQ ID NO: 4528 - DNA, 336 bp, Homo sapiens
gatgttgtgatgactcagtctccactctccctgcccgtcacccttggacagccggcctccatctcctgcaagtctagtcaaggcctcgtatacagtgatggcaacacctacgtgaattggtttcagcagaggccaggccaatctccaaggcgcctaatctatcaggtttctatccgggcctctggggtcccagacagattcagcggcagtgggtcaggcactgatttcgcactgaaaatcagcagggtggaggctgaggatgttgggctttattactgcatgcaaggtacgcactggccggtgacgttcggccaagggaccaaggtggaaatcaaa

SEQ ID NO: 4529 - DNA, 354 bp, Homo sapiens
caggtgcacctggtggagtctgggggaggcgtggtccagcctgggaagtccctaagactctcctgtgcagcctcgggattcatcttcagttcgtttggcatgcactgggtccgccagcctccaggcaaggggctggagtgggtgggagttgtgtcgtatggtggaagtgtcacgaagtattcagactcctttgagggccgattcaccatctccagagacaactccaagaattacttgtatctacaaatggacagcctgagacctgaggacacggctgtctatttctgtgcgaaaggccagggggcaaatcttcttcaggattggggccagggaatcctggtcaccgtctcctca

SEQ ID NO: 4530 - DNA, 336 bp, Homo sapiens
gatgttgtgctgactcagtctccactctccctgcccgtcacccttgggcagccggcctccatctcctgcaggtccagtgaaagcctcgtttacactgatggagacacctacttacattggtttcaccagaggccaggccaatctccaaggcgcctaattcataacgtttctaaccgggactctggggtcccagacagattcagcggcagtgggtcaggcactgatttcacactgaaaatcagcagggtggaggctgaggatgttggggtttattactgcatgcaaggtacacactggccattcactttcggccctgggaccaaagtggatatcaaa

SEQ ID NO: 4531 - DNA, 366 bp, Homo sapiens
gaggtgcagctgttggagtctgggggaggcttgggacagcctggggggtccctgagactctcctgtgcagcctctggattcacctttaatagttatgccatgagctgggtccgccaggctccagggaaggggctggagtgggtctcagctatcagtagtactggtggtaccacattctacgcagactccgtgaagggccggttcaccctctccagagacaattccaagaacacgctgtctctgcaaatgaccagcctgagagccgaggacacggccgtttattactgtgcgaaaagcggtgctcgtatagcagcagcgggtacgtttgactactggggccagggaaacctggtcaccgtctcctca

SEQ ID NO: 4532 - DNA, 327 bp, Homo sapiens
gaaattgtgttgacgcagtctccaggcaccctgtctttgtctccaggggaaagagccaccctctcctgcagggccagtcagagtgttagcagtacctacctagcctggtaccagcagaaacctggccaggctcccaggctcctcatctatggtgcatcctacagggccactggcatcccagacaggttcagtggcagtgggtctgggacagacttcactctcaccatcagcagactggaggctgaagattttgcagtgtattactgtcagcactatggtagctcaccaatatacacttttggccaggggaccaagctggagatcaaa

SEQ ID NO: 4533 - DNA, 384 bp, Homo sapiens
cagctgcagctgcaggagtcgggcccaggactactgaagccttcggagaccctgtccctcacctgcagtgtctctggtggctccatcagcagtgatagttactactggggctggatccgccagcccccagggaagggactggagtggattgggactatctattatactaggagcacctcctacaacccgtccctcaagagtcgagtcaccatatccgtagacacgtccaagaaccagttctccctgaagatgagctctgtgaccgccgcagacacggctgtctattattgtgcgagacctacgaccttttatttctatccttcggggatttcccacacctggttcgacccctggggccagggaaccctggtcaccgtctcctca

SEQ ID NO: 4534 - DNA, 336 bp, Homo sapiens
cagtctgtgctgacgcagccgccctcagtgtctggggccccagggcagagggtcaccatctcctgcactgggagcagctccaacatcggggcaggttctgatgtccactggtaccagcagcttccaggaacagcccccaaagtcctcatctatgctaacaacaatcggccctcaggggtccctgaccgattctctggctccaagtctggcacctcagcctccctggccatcactgggcttcaggctgaggatgaggctgattattactgccagtcctatgacagcagcctgagtggttcgaaggtcttcggaactgggaccaaggtcaccgtccta

SEQ ID NO: 4535 - DNA, 381 bp, Homo sapiens
caggtgcagctggtggagtctgggggaggcgtggtccagcctgggaggtccctgagactctcctgtgcagcctctggattcatcttcagtgcctatggcatgcactgggtccgccaggctccaggcaaggggctggagtgggtggcagttatatcatatgatggaagtaataaatactatacagactccgtgaagggccgattcaccatctccagagacaattccaagaacacgctgtatctgcaaatgaacagcctgagagctgaggacacggctatatattactgtgcgaaagaggccctaggatattgtagcagtagcagctgctatgggaaaaggttcgacccctggggccagggaaccctggtcaccgtctcctca

SEQ ID NO: 4536 - DNA, 339 bp, Homo sapiens
gatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagactttacactgaaaatcagcagagtggaggctgaggatgttggggtttattactgcatgcaagctctacaaattcctccgttcactttcggcggagggaccaaggtggagatcaaa

SEQ ID NO: 4537 - DNA, 384 bp, Homo sapiens
gaggtgcagctgttggagtctgggggaggcttggtacagcctggggggtccctgagactctcctgtgcagcctctggattcacctttaggagctatgtcatgagctgggtccgccaggctccggggaaggggctggagtgggtctcagctgttagtaagaatggtggtagcacatacttcgcagactccgtgaagggccggttcaccatctccagagacaattccaagaacacgctgtatctacaaatgaacagcctgagagccgaggacacggccgtatattactgtgcgaaagatggaccctatgcttcggggagaatggatttctactactactacgctatggacgtctggggccaagggaccacggtcaccgtctcctca

SEQ ID NO: 4538 - DNA, 336 bp, Homo sapiens
cagtctgccctgactcagcctgcctccgtgtctgggtctcctggacagtcgatcaccatctcctgcactggaaccagcagtaatgttgggagttataaccttgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtagcacttctttcgtggtattcggcggagggaccaaactgaccgtccta

SEQ ID NO: 4539 - DNA, 360 bp, Homo sapiens
caggtgcagctggtggagtctgggggaggcgtggtccagcctgggaggtccctgagactctcgtgtgcagcctctggttttaacctcagcaactatgctatgcactgggtccgccaggcatcaggcaaggggctggagtgggtgtcacttatatcatacgatggaagtattaaatattacagagactccgtgaagggccgattcaccgtctccggggacaattccaagaacacactgtttctgcaaatgaacagcctgcgacctgacgactcggctctttattactgtgtgaggggcggtgtcagtggcccaaattcttttgatatgtggggccaagggacaacggtcaccgtctcttcg

SEQ ID NO: 4540 - DNA, 336 bp, Homo sapiens
gatgttgtgatgactcagtctccactctccctgcccgtcacccttggacagccggcctccatctcctgcaggtctagtcaaagcctcgtttacagtgatggaaacacctacgtgaattggtttcagcagaggccaggccaatctccaaggcgcctaatctatcaggtttctatccgggcctctggggtcccagacagattcagcggcagtgggtcaggcactgatttcgcactgaaactcagcagggtggaggctgaggatgttgggatttattattgcatgcaaggtacacactggccggtgacgttcggccaagggaccaaggtggaaatcaaa

SEQ ID NO: 4541 - DNA, 336 bp, Homo sapiens
caggtgcagctgcaggagtcgggcccaggactggtgaagccttcggagaccctgtccctcacctgcagtgtctctggtggctccatcagtagttactactggagctggatccggcagcccccaggaaagggactggagtggattgggtatatctatgacagtgggagcaccaactacaacccctccctcaagagtcgagtcaccatatcagtagacacgtccaagaaccagttctccctgaagctgagctctgtgaccgctgcggacacggccgtgtattactgtgcgagggggttcgacccctggggccagggaaccctggtcaccgtctcctca

SEQ ID NO: 4542 - DNA, 324 bp, Homo sapiens
gatattgtgttgacgcagtctccaggcaccctgtctttgtctccaggggaaagagccaccctctcctgcagggccagtcagagtgttagcagcatctacttagcctggtaccagcagaaacctggccaggctcccaggctcctcatctatgctgcatccagcagggccattggcatcccagacaggttcagtggcagtgggtctgggacagaattcactctcaccatcagcagactggagcctgaagattttgcagtgtattactgtcagcaatatggtagctcaccctggacgttcggccaagggaccaaggtggaaatcaaa

SEQ ID NO: 4543 - DNA, 366 bp, Homo sapiens
gaggtgcagctgttggagtctgggggaggcttggtacagcctggggggtccctgagactctcctgtgcagcctctggattcacctttaatagctatgccatgaactgggtccgccaggctccagggaaggggctggagtgggtctcagttctttatagcggtggtagtagtacatactatgcagactccgtgaagggccggttcaccatctccagagataaatccaagaacacgctgtttctgcaaatgaacagcctgagagccgaggacacggccgtatattactgtgcgaacgccaacttagtggctggtcagtacaacggtatggacgtctggggccaagggaccacggtcaccgtctcctca

SEQ ID NO: 4544 - DNA, 321 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttacaaagtggggtcccatcaaggttcagcggcagtggatctgggacagaattcactctcaccatcagcagcctgcagcctgatgattttgcaagttactactgccaacactatagtagttattcgtggacgttcggccaagggaccaaggtggaaatcaaa

SEQ ID NO: 4545 - DNA, 375 bp, Homo sapiens
caggtgcagctgcaggagtcgggcccaggactggtgaagccttcggggaccctgtccctcacctgcggtgtctctggtgcctccatcagcactactaactggtggagttgggtccgccagcccccaggtaaggggctggagtggattggggaaatctatcatagtgggagcaccaactacaacccgtccctcaagagtcgagtcaccatatcagtagacaagtccaggaaccagttctccctgaaactgagctctgtgaccgccgcggacacggccgtgtattattgtgcgagagtcagatggttcagggagcccggcccttaccactacggtatggacgtctggggccaagggaccacggtcaccgtctcctca

SEQ ID NO: 4546 - DNA, 327 bp, Homo sapiens
gaaattgtgttgacacagtctccagccaccctgtctttgtctccaggggaaagagccaccctctcctgcagggccagtcagagtgttagcagctactttgcctggtaccaacagaaacctggccaggctcccaggctcctcatctatgatacgtccaacagggccactggcatcccagccaggttcagtggcagtgggtctgggacagacttcactctcaccatcagcagcctagagcctgaagattttgcagtttattactgtcagcagcgtagcaactggcctccccgattcactttcggccctgggaccaaagtggatatcaaa

SEQ ID NO: 4547 - DNA, 366 bp, Homo sapiens
gaggtgcagctggtggagtctggggaaaagatgacacggcctggggggtccctgagactctcctgtgcagcctctggattcacctttggtgattatggcatgagctgggtccgccaagctccagggaaggggctggagtgggtctctggtattaattggaatggtgatagtacaggttatgcagactctgtgaagggccgattcaccatctccagagacaacgccaagaactccctgtatctgcaaatgaacagtctgagagccgaggacacggccttgtattactgtgcgagagtcgggggatataacagtgcctgggacgcgtttgactactggggccagggaaccctggtcaccgtctcctca

SEQ ID NO: 4548 - DNA, 333 bp, Homo sapiens
cagcttgtgctgactcaatcgccctctgcctctgcctccctgggagcctcggtcaagctcacctgcactctgagcagtggacatagtaggttccccatcgcatggcatcagcagcagccagagaagggccctcggtacttgatgaggcttaacagtgatggcagccacagcaagggggacgggatccctcatcgcttctcaggctccagctctggggctgagcgctacctcaccatctccagcctccagtctgaggatgcggctgactattactgtcagacctggggcattggcattcaggtattcggcggagggaccaagctgaccgtccta

SEQ ID NO: 4549 - DNA, 387 bp, Homo sapiens
gaggtgcagctggtggagtctgggggaggcttggtaaagcctggggggtcccttagactctcctgtgcagcctctggattcactttcagttatgcctggatgagctgggtccgccaggctccagggaaggggctggagtgggttggccgtattaaaagcagaactgatggtgggacaacagactgcgctgcacccgtgaaaggcagattcaccatctcaagagatgattcgaaaaacacgctgtatctgcaaatgaacagtctgaaaaccgaggacacagccgtgtattactgtaccacaccccgggattattatggttcggggatttatgcttactataacggtatggacgtctggggccaagggaccacggtcaccgtctcctca

SEQ ID NO: 4550 - DNA, 318 bp, Homo sapiens
tcctatgagctgacacagccatcctcagtgtcagtgtctccgggacagacagccaggatcacctgctcaggagatgttgtgacaaaaaaatatgttcggtggttccagcagaagccaggccaggcccctgtactggtgatctatagagacagtgagcggccctcagggatccctgagcgattctccggctccagctcagggaccacagtcaccttgaccatcagcggggcccaggttgaggatgaggctgactattattgttactcagcggctgacaagtatccggtattcggcggagggaccaagctgaccgtccta

SEQ ID NO: 4551 - DNA, 360 bp, Homo sapiens
caggtgcatctggtggagtctgggggaggcgtggtccagcctgggaggtccctgagactctcctgtgcagcctctggattcaccttcagtagctatgctatccactgggtccgccaggctccaggcaagggactggagtgggtggcagttatatcatatgatggaattaataaatactacggagactccgtgaagggccgattcaccagctccagagacaattccaagaacaccctgtatctgcaaatgaacagcctgagagctgaggacacagctgtgtattactgtgccaggggtcgtgggaactaccagacttactttgactactggggccagggaaccctggtcaccgtctcctca

SEQ ID NO: 4552 - DNA, 327 bp, Homo sapiens
gaaattgtgttgacgcagtctccaggcaccctgtctttgtctccaggggaaagagccaccctctcctgcagggccagtcagagtgttagcagcaactacttagcctggtaccagcagaaacctggccaggctcccaggctcctcatctatgctgcatccagcagggccactggcatcccagacaggttcagtggcagtgggtctgggacagacttcactctcaccatcagcagactggagcctgaagattttgcaatgtattactgtcagcagtatggtcgctcacctccgatgactttcggccctgggaccaaagtggatatcaag

SEQ ID NO: 4553 - DNA, 372 bp, Homo sapiens
caggttcagctggtgcagtctggagctgaggtgaagaagcctggggcctcagtgaaggtctcctgcaaggcttctggttatagttctaccagctatggtatcagctgggtgcgacaggcccctggacaagggcttgagtggatgggatggatcagcgcttacaatggtaacacaaattatgtacagaagttccagggcagagtcaccatgaccacagacacatccacgaacacagcctacatggaggtgaggagcctgagatctgacgacacggccgtgtattactgtgcgagagatcgatccaccagtggctggtacggtgggtactactttgactactggggccagggaaccctggtcaccgtctcctca

SEQ ID NO: 4554 - DNA, 330 bp, Homo sapiens
cagtctgtgttgacgcagccgccctcagtgtctgcggccccaggacagaaggtcaccatctcctgctctggaagcagctccaacattgggaataattatgtatcctggtaccagcagctcccaggaacagcccccaaactcctcatttatgacaataataagcgaccctcagggattcctgaccgattctctggctccaagtctggcacgtcagccaccctgggcatcaccggactccagactggggacgaggccgattattactgcggaacatgggatcgcagcctgagtgcttgggtgttcggcggagggaccaagctgaccgtccta

SEQ ID NO: 4555 - DNA, 354 bp, Homo sapiens
gaggtgcaactggtggagtctggaggaggcttgatccagcctggggggtccctgagactctcctgtgcagcctctgggttcaccgtcagcagcaattacatgagctgggtccgccagactccagggaaggggctggaatgggtctctattatttatagcggtgggagaacatactacagagactccgtgaagggccgattcaccatctccagagacaattccaagaacacactgtctcttcaaatgaacagcctgagagtcgaggacacggccgtttattactgtgcggctatagtggaaccgacacgctggtttgacttctggggccagggaaccctggtcaccgtctcctca

SEQ ID NO: 4556 - DNA, 324 bp, Homo sapiens
gaaatagttatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgagacagagttcactctcaccatcagcagcctgcagtctgaagattttgcagtttattactgtcagcagtataatcactggcctccttggacgttcggccaggggaccaaggtggaaatcaaa

SEQ ID NO: 4557 - DNA, 375 bp, Homo sapiens
caggtgcagctacagcagtggggcgcaggactgttgaagccttcggagaccctgtccctcacctgcggtgtctatggtgcgtccttcagtggttactactggagctggatccgccagcccccagggaaggggctggagtggattggggaaatcaatcatagtggaagcactaactacaacccgtccctcaagagtcgagtcaccatatcagttgacacgtccaagaaccagttctccctgaagctgaactctgtgaccgccgcggacacggctgtgtattactgtgcgagagggctctggtggtccttgactacattgaccccgagggggtacttccagcactggggccagggcgccctggtcaccgtctcctca

SEQ ID NO: 4558 - DNA, 336 bp, Homo sapiens
gagattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaa

SEQ ID NO: 4559 - DNA, 381 bp, Homo sapiens
caggtgcagttggtggagtctgggggaggcgtggtccagcctgggaggtccctgagactctcctgtgcagcctctggattcattttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgtgtattactgtgcgagagatttgccccattactatggttcagggagtcgggggggctacggtatggacgtctggggccaagggaccacggtcaccgtctcctca

SEQ ID NO: 4560 - DNA, 321 bp, Homo sapiens
gacatccagatgacccagtctccatcctccctgtctgcatctgtaggagacagagtcaccatcacttgccgggcaagtcagagcattagcagctatttaaattggtatcagcaaaaaccagggaaagcccctaagctcctgatctatgctgcatccagtttgcaaagtggggtcccatcaaggttcagtggcagtggatctgggacagatttcactctcaccatcagcagtctgcaacctgaagattttgcagcttactactgtcaacagacttacagtaccctcctcactttcggcggagggaccaaggtggagatcaaa

SEQ ID NO: 4561 - DNA, 360 bp, Homo sapiens
caggtgcacctgcaggagtcgggcccaggactggtgaagccttcggagaccctgtccctcacctgcactgtctctggtggctccatcagttggtactactggagctggatccggcagcccccagggaagggactggagtggattgcatatatctattacaatgggagcaccaattacaacccctccctcaagagtcgagtcacgatatcagtagacacgtcgaagaagcagatttccctgaagctgagctctctgaccgctgcggacacggccgtgtattactgtgcgagaggtccgccccgtttgggggacttatccttctgggggtggggccagggaaccctggtcaccgtctcctca

SEQ ID NO: 4562 - DNA, 336 bp, Homo sapiens
gatattgtgatgactcagtctccactctccctgcccgtcacccctggagagccggcctccatctcctgcaggtctagtcagagcctcctgcatagtaatggaaacatctatttggattggtacatacagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaggctctacaaactcctctcactttcggcggagggaccaaggtggagatcaaa

SEQ ID NO: 4563 - DNA, 399 bp, Homo sapiens
caggtgcagctggtggagtctgggggaggcgtggtccagcctgggaggtccctgagactctcctgtacagcctctggattcaccttcagtagctatgctatgcactgggtccgccaggctccaggcaaggggctggagtgggtggcggttatatcgtatgatggaaataataaatattatggagactctgtgaagggccgattcaccatctccagagacaattccaagaacaccctgtatctgcagatgaacagcctgagagctgaggacacggctgtgtattactgcgcgaaaggtgccgacaccccccattatagtggctatcattttttgtctgtcggctactacttctacggtatggacgtctggggccaagggaccacggtcaccgtctcctca

SEQ ID NO: 4564 - DNA, 321 bp, Homo sapiens
gacatccagatgacccagtctccatcctccctgtctgcatctgtaggagacagagtcaccatcacttgccgggcaagtcagagcattagctactatttaaattggtatcagcagaaaccagggaaagcccctcagctcctgatctatgctgcatccagtttgcaaagtggggtcccatcaaggttcagtggcagtagatctgggacagatttcactctcaccatcagcagtctgcaacctgaagactttgcaacttattactgtcaacagagttacagtactccattcactttcggccctgggaccaaagtcgatatcaaa

SEQ ID NO: 4565 - DNA, 366 bp, Homo sapiens
gaggtgcagctgttggagtctgggggaggcttggtacagcctggggggtccatgagactctcctgtgaagcctctggattcacctttagcagttatgccatgagctgggtccgccaggctccagggaaggggctggagtgggtctcaactattactggtagtggtcataacacatactacgcagactccgtgaagggccggttcaccatctccagagacaactccaacaacacgttgtatctgcaaataaacagcctgagagccgaggatacggccgtatattactgtgcgaaagattcccgttgtactcatattacctgctactttgactactggggccaggggacccttgtcaccgtctcctca

SEQ ID NO: 4566 - DNA, 321 bp, Homo sapiens
gacatccagatgacccagtctccttccaccctgtctgcatctgtaggagacagagtcaccatcacttgccgggccagtcacagtattactacctggttggcctggtatcagcagaaaccggggaaagcccctaaactcctgatctataagacgtctactttagaaagtggggtcccatcaaggttcagcggcagtggatctgggacagaattcactctcaccatcagcagcctgcagcctgatgattttgcaacttattactgccaacagtatcagagtgatccgtggacgttcggccaagggaccaaggtggaagtcaaa

SEQ ID NO: 4567 - DNA, 360 bp, Homo sapiens
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatattgtatgatggaagtaataaatactatgcagactccgtgaagggccgattcaccatctccagagacaattccaagaacacgctgtatctgcaaatgaacagcctgagagccgaggacacgtctgtgtatttctgtgcgagagactacggtgaatacactacgtggtttgactactggggccagggaaccctggtcaccgtctcctca

SEQ ID NO: 4568 - DNA, 324 bp, Homo sapiens
gacatccagatgacccagtctccatcctccctgtctgcatctgtaggagacagagtcaccatcacttgccgggcaagtcagagcattagcagctatttaaattggtatcagcacaaaccagggaaagcccctaagctcctgatctatcttgcatccagtttgcaaagtggggtcccatcaaggttcagtggcagtggatctgggacagatttcactctcaccatcagcagtctgcaacctgaagattttgcaacttactactgtcaacagagttacagtacccctccgtggacgttcggccaagggaccaaggtggaaatcaaa

SEQ ID NO: 4569 - DNA, 360 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagatccggttcggggagttattactcgtttgactactggggccagggaaccctggtcaccgtctcctca

SEQ ID NO: 4570 - DNA, 327 bp, Homo sapiens
caggctgtggtgactcaggagccctcactgactgtgtccccaggagggacagtcactctcacctgtggctccagcactggagctgtcaccagtggtcattatccctactggttccagcagaagcctggccaagcccccaggacactgatttatgatacaagcaacaaacactcctggacccctgcccggttctcaggctccctccttgggggcaaagctgccctgaccctttcgggtgcgcagcctgaggatgaggctgagtattactgcttgctctcctatagtggtgccgtggtattcggcggagggaccaagctgaccgtccta

SEQ ID NO: 4571 - DNA, 357 bp, Homo sapiens
caggtgcagctggtggagtctgggggaggcgtggtccagcctgggaagtccctgagactctcctgtgcagcctctggattcaccttcagtacctatgctatgcactgggtccgccaggctccaggcaaggggctggagtgggtggcagttatttcatttgatggaagtaataaatattacgcagactccgtgaagggccgattcaccatctccagagacaattctaagaacacgctgtatctgcaaatgagcagcctgagaactgacgacacggctctgtattattgtgcgagagccgactgggcgtggttattactaaactactggggccagggaaccctggtcaccgtctcctca

SEQ ID NO: 4572 - DNA, 336 bp, Homo sapiens
cagcttgtggtgactcaatcgccctctgcctctgcctccctgggagcctcggtcaagctcacctgcactctgagcagtgggcacagcagctacgccatcgcatggcatcagcagcagccagagaagggccctcggtacttgctgaagcttaacagtgatggcagccacagcaagggggacggggtccctgatcgcttctcaggctccagctctggggctgagcgctacctcaccatctccagcctccagtctgaagatgaggctgactattattgtcagacctggggcactggctttcatgtggtattcggcggagggaccaaggtgaccgtccta

SEQ ID NO: 4573 - DNA, 387 bp, Homo sapiens
gaggtccagctggtacagtctggggctgaggtgaagaagcctggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacatcctacatggagctgagcagcctgagatctgaggacacggccgtgtattactgtgcaacagaaagccgatctctaggatattgtagtggtggtagctgctcctcgtactggttcgacccctggggccagggaaccctggtcaccgtctcctca

SEQ ID NO: 4574 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccctcgatcaccttcggccaagggacacgactggagattaaa

SEQ ID NO: 4575 - DNA, 378 bp, Homo sapiens
caggtccagcttgtgcagtctggggctgagatgaagaggcctggggactcagtgaaagtttcctgcatggcttctggatacaccttcgctgcctatgctgtgcattgggtgcgccaggcccccggacagaggcttgagtggatgggatggatcggcactggcaatggtgacacaaaatattcacagaagttccagggcagagtctccattaccagggacacattcgcgagcacagcctacatggagctgagcagcctgagatctgaagacacggctgtgtattactgtgcgagaggggggcagctggtacggctcactctttattactactacgctttggacgtctggggccaagggaccacggtcaccgtctcctca

SEQ ID NO: 4576 - DNA, 336 bp, Homo sapiens
gatattgtgatgactcagtctccactctccctgcccgtcacccctggagagccggcctccatctcctgcaggtctagtcagagcctcctgcacagtactggatacaactatttggattggtacctgcagaagccagggcagtctccacagctcctgatctatttgggttctaatcgggcctccggggtccctgacaggttcagtggcagtggatcaggcacagcttttacactgaagatcagcagagtggaggctgaggatgttggggtttattactgcatgcaaggtctacaaactcctgctacgttcggccaagggaccaaggtggaaatcaaa

SEQ ID NO: 4577 - DNA, 369 bp, Homo sapiens
gaggtgcagctggtggagtctgggggaggcttggtacagcctggggggtccctgagactctcctgtgcagcctctggattcaccttcagtgactacgacatgcactgggtccgccaagtttcaggacaaggtctggagtgggtctcagctattggtactgctgctgacacatactatccagactccgtgaagggccgattcaccatctccagagaaaatgccaagaactccttgtatcttcaaatgaacagcctgagagccggggacacggctgtgtattactgtgcaagagcgggggccccgattggttattatgtaagctggtacttcgatctctggggccgtggcaccctggtcactgtctcctca

SEQ ID NO: 4578 - DNA, 324 bp, Homo sapiens
gacatccagatgacccagtctccatcctccctgtctgcatctgtaggagacagagtcaccatcacttgccgggcaagtcagagcattagcaggtatttaaattggtatcagcagaaaccagggacagcccctaggctcctgatctatgctgcatccagtttgcaaagtggggtcccatcaaggatcagtggcagtggatctgggacagatttcactctcactatcagcagtctgcaacctgaagattttgcaacttactactgtcaacagagttacagtatgcctcccatcactttcggccctgggaccaaagtggatatgaaa

SEQ ID NO: 4579 - DNA, 378 bp, Homo sapiens
caggttcagctggtgcagtctggagctgaggtgaagaagcctggggcctcagtgaaggtctcctgcaaggcttctggttacacctttaccacctatggtatcagttgggtgcgacaggcccctggacaagggcttgagtggatgggatggatcagcgcttacagtggtgacacaaagtatgcacagaagttccagggcagagtcaccatgaccacagacacatccacgagaacagcctacatggagctgaggagcctgagatctgacgacacggccgtgtattattgtgcgagagattactatgatagtagtggttacagttactactaccacggtatggacgtctggggccaagggaccacggtcaccgtctcctca

SEQ ID NO: 4580 - DNA, 339 bp, Homo sapiens
gacatcgtgatgacccagtctccagactccctggctgtgtctctgggcgagagggccaccatcaactgcaggtccagccagagtgttttatacacctccaacaataagcactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatagtactcccttcactttcggccctgggaccaaagtggatatcaaa

SEQ ID NO: 4581 - DNA, 393 bp, Homo sapiens
cagatgcagctggtgcagtctggggctgaggtgaagaagcctgggtcctcggtgaaggtctcctgtaaggcttctggaggcaccttcagcagcgatgctatcagctgggtgcgacaggcccctggacaagggcttgagtggatgggaaggatcagcccaatccttggtatagcaaactacgcacagaagttccagggcagagtcacgattaccgcggacaaatccacgagcacagcctacatggagctgagcagcctgagatctgaggacacggccgtgtattactgtgcgagagatgtaatggattcggggagttattatcgaatagaaataggctactactactacggtatggacgtctggggccaagggaccacggtcaccgtctcctca

SEQ ID NO: 4582 - DNA, 321 bp, Homo sapiens
gaaattgtgttgacacagtcgccagccaccctgtctttgtctccaggggaaagagccaccctctcctgcagggccagtcagagtgttagcagcgacttagcctggtaccaacagaaacctggccaggctcccaggctcctcatctataatgcatccaacagggccactggcatcccagccaggttcagtggcagtgggtctgggacagacttcactctcaccatcagcaggctagagcctgcagattttgcagtttattactgtcagcagcgtagcaactggcctctcactttcggcggagggaccaaggtggagatcaaa

SEQ ID NO: 4583 - DNA, 381 bp, Homo sapiens
caggtgcagctgcaggagtcgggcccaggactagtgaagccttcacagaccctgtccctcacctgcagtgtctctggtggctccatcatcaatggtcattactactggagttggatccggcagcccgccgggaagggactggagtggattgggcgtatccataccagtgggggcaccaactacatcccctccctcaagagtcgagtcaccatatcggtagacacgtccaagaaccagttctccctgaagctgcgctctgtgaccgccgcagacacggccgtgtattactgtgcgagagaagaatattgtagtggtgataactgctcccgggccaattggttcgacccctggggccagggaaccctggtcaccgtctcctca

SEQ ID NO: 4584 - DNA, 333 bp, Homo sapiens
cagtctgtgctgacgcagccgccctcagtgtctggggccccagggcagagggtcaccatctcctgcactgggagcagctccaacatcggggcaggttatggtgtacactggtaccagcaacttccaggaatagcccccaaacttctcatctatggtaacaccaatcggccgtcaggggtccctgaccgattctctggctccaagtctggcacctcagcctcgctggccctcactggactccaggctgacgatgaggctgattattactgccagtcctatgacagcagtctgagtgacgtggtattcggcggagggaccaagctgaccgtcctg

SEQ ID NO: 4585 - DNA, 369 bp, Homo sapiens
gaggtgcagctggtggagtctgggggaggcttggtacagcctggggggtccctgagactctcctgtgcagcctctggattcaccttcagtagctacgacatgcactgggtccgccaagctacaggaaaaggtctggagtgggtctcacttattggtactgctggtgacacatattatccagactccgtgaagggccgattcaccatctccagagaaaatgccaagaactccttgtatcttcaaatgaacagcctgagagccggggacacggctgtgtattactgtgcaaggggttactatgataatagtggttattactctttgggtatggacgtctggggccaagggaccacggtcaccgtctcctca

SEQ ID NO: 4586 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctggagattttgcaacttactactgtcaacagagttacattatgcctcactacacttttggccaggggaccaagctggagatcaaa

SEQ ID NO: 4587 - DNA, 402 bp, Homo sapiens
gaggtgcagctggtggagtctgggggaggcttggtacagcctggggggtccctgagactctcctgtgcagcctctggattcatcttcagtagttataacatgaactgggtccgccaggctccagggaaggggctggagtgggtttcatacattagttatagtagtagtaccatatactacgcagactctgtgaagggccgattcaccatctccagagacaacgccaacaactcactgtctctgcaaatgaccagcctgagagccgaggacacggctgtgtattactgtgcgagagatcccctcttaccccctctaccaactgctatgtccggaagggagtattactatgactacttcggtatggaggtctggggccaagggaccacggtcaccgtctcctca

SEQ ID NO: 4588 - DNA, 321 bp, Homo sapiens
gacatccaaatgacccagtctccatcttctgtgtctgcctctgtaggagacagagtcaccatcacttgtcgggcgagtcagggtattagcaggtggttagcctggtatcagcagaaaccagggaaagcccctaagctcctgatctatggtgcatccactttgcaaagtggggtcccatcaaggttcagcggcagtggatctgggacagatttcactctcactatcagcagcctgcagcctgaagattttgcaacttactattgtcaacaggctaacagtttcccttacacttttggccaggggaccaagctggagatcaaa

SEQ ID NO: 4589 - DNA, 366 bp, Homo sapiens
gaggtgcagctggtggagtctggaggaggcttgatccagcctggggggtccctgagactctcctgtgcagcctctgggttaaccgtcagtagcaactatatgagctgggtccgccaggctccagggaaggggctggagtgggtctcagttatttatagcgggggtagtacatactacgcagactccgtgaagggccgattcaccatctccagagacaattccaagaacacgctgtatcttcaattgaacagcctgagagccgaggacacggccgtgtattactgtgcgagagtgggcgggtattgtagtggtagtaactgctactctgactactggggccagggaaccctggtcaccgtctcctca

SEQ ID NO: 4590 - DNA, 321 bp, Homo sapiens
gacatccagatgacccagtctccatcctccctgtctgcatctctgggggacagagtcaccatcacttgccaggcgagtcaggacattaggaactatttaaattggtatcagcagaaaccagggaaagcccctaagctcctgatctacgatgtatccaatttggaaacaggggtcccatcaaggttcagtggaagtggatctgggacagattttgctttcaccatcagcagcctgcagcctgaagatattgcaacatattactgtcaacagtatgataatctccccatcaccttcggccaagggacacgactggagattaaa

SEQ ID NO: 4591 - DNA, 381 bp, Homo sapiens
caggtgcagctggtggagtctgggggaggcgtggtccagcctgggaggtccctgagactctcctgtgcagcgtctggattcaccttcagtgcctatggcatgcactgggtccgccaggctccaggcaaggggctggagtgggtggcagttatatggtatgatggaagtgatgaatactatgcagactccgtgaagggccgattcaccatctccagagacaattccaagaacacggtgtatctgcaaatgaacagcctgggagccgaggacacggctgtctattactgtgcgaaagatagactaggatattgcagtggtggtagctgctacgggggggctcttgcctactggggccagggaaccctggtcaccgtctcctca

SEQ ID NO: 4592 - DNA, 336 bp, Homo sapiens
gatgttgtgatgactcagtctccactctccctgcccgtcacccctggagagccggcctccatctcctgcaggtctagtcagagcctcctgcatagtaatggatacaatcatttggattggtacctgaagaagccagggcagtctccacagctcctgatctatttgggttctactcgggcctccggggtccctgacaggttcagtggcagtggatcaggcacagattttacactgaaaatcagcagagtggaggctgaggatgttggggtttattactgcatgcaaactctacacagtcctttcactttcggccctgggaccacagtggatatcaga

SEQ ID NO: 4593 - DNA, 372 bp, Homo sapiens
gaggtgcatctggtgcagtctggagcagaggtgaaaaagcccggggagtctctgaagatctcctgtaagggttctggaaacagctttactgactactggatcggctgggtgcgccagatgcccgggaaaggcctggagtggatggggatcatctatcctgatgactctaatatcagatatagtccgtccttccaaggccaggtcaccatctcagccgacaagtccatcaccaccgcctacgtgcagtggagcagcctgaaggcctcggacaccgccatgtattactgtgcgagactggcatacccgtctacggtgaccaccgaactccactttgactactggggcccgggaaccctggtcaccgtctcctca

SEQ ID NO: 4594 - DNA, 318 bp, Homo sapiens
tcctatgagctgactcagccaccctcagtgtccgtgtccccaggacagacagccagcatcacctgctctggagataaattgggggataaatatgcttcctggtatcagcagaagccaggccagtcccctgtggtggtcatctatgaagatagcaagcggccctcagggatccccgagcgattctctggctccaagtctgggaacacagccactctgaccatcagcgggacccaggctatggatgaggctgactattactgtcaggcgtgggacaccatttatgtggtgttcggcggagggaccaagctgaccgtccta

SEQ ID NO: 4595 - DNA, 366 bp, Homo sapiens
caggtgcagctgcaggagtcgggcccaggactggtgaagccttcggagaccctcttcctcacctgcactgtctctggttactccatcagcagtccttactactggggctggatccggcagcccccagggaaggggctggagtggattgggagtagcgatgatactgggagcacctactacaacccgtccctcaagagtcgagtcgccatatcagtagacacgtccaagaaccagttctccctgaagctgagctctgtgaccgccgcagacacggccgtgtattactgtgtgagagatcccgatgatagtagtgattatcggacctttgactactggggccagggaaccctggtcaccgtctcctca

SEQ ID NO: 4596 - DNA, 321 bp, Homo sapiens
gacatccagatgacccagtctccttccaccctgtctgcatctgtaggagacagagtcaccatcacttgccgggccagtcagagtattaataactggttggcctggtatcagcagaaaccagggaaagcccctaaggtcctgatctataaggcgtctattttagaaaatggggtcccatcaaggttcagcggcagtggatctgggacagaattcactctcaccatcagcagcctgcagcctgatgattttgcaacttattactgccaacagtatagtaggtatccgtacacttttggccaggggaccaagctggagatcaaa

SEQ ID NO: 4597 - DNA, 357 bp, Homo sapiens
gaggtgcagctggtggagtctgggggaggcttggtacagcctggggggtccctgagactctcctgtgcagcctctggattcaccttcagtaactacgacatgcactgggtccgccaaactacaggaaaaggtctggagtgggtctcaactattggtacttctggtgacacatactatccaggctccgtgaagggccgattcaccatctccagagaaaatggcaagaactccttgtatcttcaaatgaacagcctgagagccggggacacggctgtgtattactgtgcaagaggatatagtggctacgataccgtttttgactactggggccagggagccctggtcaccgtctcctca

SEQ ID NO: 4598 - DNA, 324 bp, Homo sapiens
gacatccagatgacccagtctccatcctccctgtctgcatctgtaggagacagagtcaccatcacttgccgggcaagtcagagcattcgcagtcatttaaattggtatcagcagaaaccagggaaagcccctaaactcctgatctatgctgcatccagtttgcaaagtggggtcccatcaaggttcagtggcagtggatctgggacagatttcacgctcaccatcagcagtctgcaacctgaagattttgcaacttactactgtcaacagagttacactaatcctccgatcaccttcggccaagggacacgactggagattaaa

SEQ ID NO: 4599 - DNA, 360 bp, Homo sapiens
caggtgcagctggtggagtctgggggaggcgtggtccagcctgggaggtccctgagactctcctgtgcagcgtctggattcaccttcagtagctctggcatgcactgggtccgccaggctccaggcaaggggctggaatgggtggcagttatatggtatgatggaaataataaatactatggagactccgtgaagggccgattcaccatctccagagacaattccaagaacacggtgtatctgcaaatgaatagcctgagcgccgaggacacggctatctattactgtgcgaaagatcgtctcggggctggtaactactttgactcctggggccagggaaccctggtcaccgtctcctca

SEQ ID NO: 4600 - DNA, 327 bp, Homo sapiens
gaaattgtgttgacacagtctccagccaccctgtctttgtctccaggggaaagagccaccctctcctgcagggccagtcagagtgttagcagcttcctagcctggtaccaacagaaagctggccaggctcccagactcctcatctatgatgcatccaacagggccactggcatcccagccaggttcagtggcagtgggtctgggacagacttcactctcaccatcagcagcctagagcctgaagattttgcagtttattactgtcaggagcgtagcaactggcctccgaccttcactttcggccctgggaccaaagtggatatcaaa

SEQ ID NO: 4601 - DNA, 363 bp, Homo sapiens
caggtgcagctggtggagtctgggggaggcgtggtccagcctgggaggtccctgagactctcctgtgcagcctctggattcaccttcagtagttatgctatgcactgggtccgccaggctccaggcaaggggctggagtgggtggcagctatatcatctgaaggaaataataaattctatggagactccgtgaagggccgattcaccatctccagagacaattccaagaacacactatatctgcaattgaacagcctgagagctgaggacacggctgtttattactgtgcgaaagacctgggcagcagctggtatgatgtttttgatgtctggggccaagggacaatggtcaccgtctcttca

SEQ ID NO: 4602 - DNA, 324 bp, Homo sapiens
gacatccagatgacccagtctccatcctccctgtctgcatctgtaggagacagagtcaccatcacttgccgggccagtcagaccattagcacctatttaaattggtatcagcagaaaccagggaaagcccctaggctcctgatctatgctgcatccagtttgcaaagtggggtcccatcaaggttcagcggcagtgcatctgggacagatttcactctcaccatcagcagtctgcaacctgaagattttgcaacttactactgtcaacagagttacagtacccctccgtggacgttcggccaagggaccatggtggagatcaaa

SEQ ID NO: 4603 - DNA, 357 bp, Homo sapiens
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatctaagcaatctacggtggtacgactactggggccagggaaccctggtcaccgtctcctca

SEQ ID NO: 4604 - DNA, 324 bp, Homo sapiens; identical to SEQ ID NO: 352

SEQ ID NO: 4605 - DNA, 378 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaactaataaatactacgcagactccgtgaagggccgattcaccatctccagagacaattccaagaacacgctgtatctgcaaatgaacagcctgagagctgaggacacggctgtgtacttctgtgcgagagattatgttgcagtggtggtagcggactactggtactacggtatggacgtctggggccaagggaccacggtcaccgtctcctca

SEQ ID NO: 4606 - DNA, 348 bp, Homo sapiens
caggctgtgctgactcagccgtcttccctctctgcatctcctggagcatcagccagtctcacctgcaccttacgcagtggcatcaatgttggtacctacaggatatactggtaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtatgatttggcacagcagcgcttctgcggtattcggcggagggaccaagctgaccgtccta

SEQ ID NO: 4607 - DNA, 363 bp, Homo sapiens
caggtcctattggtgcaatctgggactgaagtgaagaagcctgggtcctcggtgaaggtctcctgcaaggcttctggaggcccctccatcaccaagactttcggctgggtgcgccaggcccctggacaagggcttgagtggatgggaaggatcatccctctccttggtgtcccaaactacgcacagaagttccagggcagagtcacgattaccgcggacaaatctacgaacacagtctatatggaactgagcagcctgagagctgacgacacggccgtatattactgtgcgacagtggggacatattgtagcggtgattgctattcggactggggccagggaaccctggtcatcgtctcctca

SEQ ID NO: 4608 - DNA, 318 bp, Homo sapiens
gaaatccggatgacccagtctccctcctccctgtctgcatctgtaggagagagagtcattatcacttgccaggcgagtcaggacattagcaaatttgtaaattggtatcagcagaaaccagggaaagcccctaagctcctgatctacgatgcatccaacttggaaagaggggtcccatcaaggttcagaggaaatggatctgggacggattttacttttacaatcagcagcatgcagcctgaggacattgcaagatattactgtcaacagtatgatgtgctccctctgtttggccaggggaccagggtggacatcaaa

SEQ ID NO: 4609 - DNA, 405 bp, Homo sapiens
caggtcaccttgagggagtctggtcctgcgctggtgaaacccacacagaccctcacactgacctgcaccttctctgggttctcactcaacactagtggaatgtgtgtaacctggatccgtcagcccccagggaaggccctggagtggcttgcactcattgattgggatgatgataaatactacaacacatctctgaggaccaggctcaccatctccaaggacacctccaaaaaccaggtggtccttacaatgaccaacatggaccctgtggacacagccacgtattactgtgcacgcataccgcgagttaggattctttattatggttcggggagttatccaacccttatcgctgactacggtatggacgtctggggccaagggaccacggtcaccgtctcctca

SEQ ID NO: 4610 - DNA, 321 bp, Homo sapiens
gacacccagatgacccagtctccatcctccctgtctgcatctgtaggagacagagtcaccatcacttgccgggcaagtcagagcattagcagctatttaaattggtatcagcagaaaccagggaaagcccctaagctcctgatctatgatgcatccagtttgcaaagtggggtcccatcaaggttcagtggcagtagatctgggacagacttcactctcaccatcagcagtctgcagcctgaagattttgcaacttactactgtcaacagagttacgacacccctcgatctttcggccaagggacacgactggagattaaa

SEQ ID NO: 4611 - DNA, 384 bp, Homo sapiens
caggtgcagctggtggactctgggggaggcgtggtccagcctgggaggtccctgagactctcctgtgcagcctctggattctccttcagtagctatgctatgcactgggtccgccaggctccaggcaaggggctggagtgggtggcacttatatcatatgatggaagcgataaatactccgcagactccgtggagggccggttcaccatctccagagacaattccaagaacacgttgtatctgcaaatgaacagcctgagagctgaggacacggctctatattactgtgcgagagatcttccaaaaaatagcagcggttggttcgttgactattactacggtatggacgtctggggccaagggaccacggtcaccgtctcctca

SEQ ID NO: 4612 - DNA, 321 bp, Homo sapiens
gacatccagctgacccagtctccatcttctgtgtctgcatctgtaggagacagagtcaccatcacttgtcgggcgagtcagggtattagcacctggttagcctggtatcagcagaaaccagggaaagcccctaagctcctgatccatgctgcatccagtttgcaaagtggggtcccatcaaggttcagcggcagtggatctgggacagatttcactctcactatcggtagcctgcagcctgaagattttgcaacttactattgtcagcaggccaacagtttcccactcactttcggccctgggaccaaagtggatatcaga

SEQ ID NO: 4613 - DNA, 366 bp, Homo sapiens
caggtgcagctggtgcagtctagggctgaggtgaagaagcctggggcctcagtgaaggtctcctgcaaggcatctggatacaccttcatcagctactatatgcactgggtgcgacaggcccctggacaagggcttgagtggatgggaacaatcaaccctagtggtggtagcacaatctacgcacagaagttccagggcagagtcaccatgaccagggacacgtccacgagtacagtctacatggagctgagcagcctgagatctgaggacacggccgtgtattactgtgcgaccggtgatgactacggtgactacagggggtggttcgacccctggggccagggaaccctggtcaccgtctcctca

SEQ ID NO: 4614 - DNA, 330 bp, Homo sapiens
gaaattgtgttgacacagtctccagccaccctgtctttgtctccaggggaaagagccaccctctcctgcagggccagtcagagtgttttcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcaccagcgtagcacctggcctcctggggggttcactttcggccctgggaccaaagtggatatcaaa

SEQ ID NO: 4615 - DNA, 366 bp, Homo sapiens; identical to SEQ ID NO: 4595

SEQ ID NO: 4616 - DNA, 321 bp, Homo sapiens
gacatccagatgacccagtctccatcctcactgtctgcatctgtaggagacagagtcaccatcacttgtcgggcgagtcagggcattaagatttatttagtctggcttcagcagaaaccagggaaagcccctaagtccctgatctatgctgcatccagtttgcaaagtggggtcccatcaaaattcagcggcagtggatctgggacagatttcactctcaccatcagcagcctgcagcctgaagattttgcaacttattactgccaacagtattatagttaccctctcactttcggcggagggaccaaggtggagatcaaa

SEQ ID NO: 4617 - DNA, 369 bp, Homo sapiens
caggtgcagctggtggagtctgggggaggcgtggtccagcctgggaggtccctgagactctcctgtgcagcctctggattcaccttcagtacctatggcatgcactgggtccgccaggctccaggcaaggggctgcagtgggtggcagttatatcatatgatggaagtaataaatactatgcagactccgtgaagggccgattcaccatctccagagacaattccaagaacaaggtgtatctgcaaatgaacagcctgagagctgaggacacggctgtgtattactgtgcgaaagatcgggaaattgtagtggtggtagctgctggacttgactactggggccagggaaccctggtcaccgtctcctca

SEQ ID NO: 4618 - DNA, 318 bp, Homo sapiens
tcctatgagctgactcagccaccctcagtgtccgtgtccccaggacagacagccagcatcacctgctctggagatgatttggggtataaatatgcttgctggtatcagcagaagccaggccagtcccctgtactggtcatctatcaatataacaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtccta

SEQ ID NO: 4619 - DNA, 387 bp, Homo sapiens
caggtgcagctggtgcaatctgggtctgtattgaagaagcctggggcctcagtgaaggttgcctgcaaggcttctggatacacctttgataactttgctataaactgggtgcgacaggcccctggacaagggcttgagtggatggggtggctcaacaccaaaactgggaccccaacgtatgcccagggcctcagaggacgatttgtcttctccttggacacctctgtcaacacggcatatctgcagatcagtagcctaaaggctgaggacactgccgtgtattactgtgcgagagttgccactacggttcagggagttattataactttggactactactacggtatggacgtctggggccaagggaccacggtcaccgtctcctca

SEQ ID NO: 4620 - DNA, 333 bp, Homo sapiens
cagtctgccctgactcagccagcctccgtgtctgggtctcctggacagtcgatcaccatctcctgcactggaaccagcagtgacgttggtggttacaactatgtctcctggtaccaacagtacccaggcgaagcccccaaactcgtgatttatgatgtcagtaatcggccctcaggggtttctaatcgcttctctggctccaagtctggcaacacggcctccctgaccatcgctgggctccgggctgcggacgaggctgattattactgcacctcatctacaagcagcagcactctcgtggttttcggcggagggaccaagctgtccgtccta

SEQ ID NO: 4621 - DNA, 363 bp, Homo sapiens
caggtgcagatggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaaataataaatactacgcagactccgtgaggggccgattcaccatctccagagacaattccaagaacacgctgtatctgcaaatgaacagcctgagagctgaggacacggctgtgtattactgtgcgaaatcccggggggggagctactcgagtccttttgatatctggggccaagggacaatggtcaccgtctcttca

SEQ ID NO: 4622 - DNA, 321 bp, Homo sapiens
gaaattgtgttgacgcagtctccaggcacgctgtctttgtctccaggggaaagagccaccctctcctgcagggccagtcagcgtgttagcagcagctacttagcctggtaccagcagaaacctggccaggctcccaggctcctcatctatggtgcatccagcagggccactggcatcccagacagattcagtggcagtgggtctgggacagacttcactctcaccatcagcagactggagcctgaggattttgcagtgtattactgtcagcagtatcacctcggactcactttcggcggagggaccaaggtggagatcaaa

SEQ ID NO: 4623 - DNA, 351 bp, Homo sapiens
gaggtgcagttggtggagtctggaggaggcttgatccagcctggggggtccctgagactctcctgtgcagcctctggggtcaccgtcagtaacaactacatgagctgggtccgccaggctccagggaaggggctggagtgggtctcacttctttatagcggtgggaccacctactacgcagactccgtgaagggccgattcaccatctccagagacaattccaagaacacactgtatcttcaaatgaacagtctgagagccgaagacacggccgtgtattactgtgcgagagatctggttgcctacggtatggacgtctggggccaagggaccacggtcaccgtctcctca

SEQ ID NO: 4624 - DNA, 321 bp, Homo sapiens
gacatccagttgacccagtctccatccttcctgtctgcatctgtaggagacagagtcaccatcacttgccgggccagtcaaggcattagtaattatttagcctggtatcagcaaaaagcagggaaagcccctaagctcctgatctatgctgcatccactttgcaaagtggggtcccatcaaggttcagcggcagtggatctgggacagaattcactctcacaatcagcagcctgcagcctgaagattttgcaacgtattactgtcagcagcttaatagtgacctgatcaccttcggccaagggacacgactggagattaaa

SEQ ID NO: 4625 - DNA, 381 bp, Homo sapiens
cagctgcagctgcaggagtcgggcccaggacgggtgaagccttcggagaccctgtccctcacctgcactgtctctggtggctccatcagcaatattaattactactgggcctggatccgccagcccccagggaaggggctggagtggattgggaatatgtatcatagtgggagcacctactacaacccgtccctcaagagtcgagtcatcatatccgtagacacgtccaagaaccagatctccctgaagctgagctctgtgaccgccgcagacacggcggtgtattactgtgcgagtgagcggttcggggacttattagggggtttcaattttggcggtatggacgtctggggccaagggaccacggtcaccgtctcctca

SEQ ID NO: 4626 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattataatactcctcggacgttcggccaggggaccaaggtggaaatcaaa

SEQ ID NO: 4627 - DNA, 381 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtggctggcagttatatcatatgatggaactaaaatatattatgcagactccgtgaagggccgattcaccatctccagagacaattccaagaacacgctgtatctgcaaatgaacagcctgagagctgaggacacggctgtctattactgtgcgaagcaaggggggccctattgtagtggtggtgactgctactccggggactttgactactggggccagggaaccctggtcaccgtctcctca

SEQ ID NO: 4628 - DNA, 327 bp, Homo sapiens
gaaattgtgttgacgcagtctccaggcaccctgtctttgtctccaggggaaagagccaccctctcctgcagggccagtcagagtgttagcagcagctacttagcctggtaccagcaaaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtagctcaccgccgctcactttcggcggagggacgaaggtggagatcaaa

SEQ ID NO: 4629 - DNA, 357 bp, Homo sapiens
cagatgcagctacagcagtggggcgcaggactgttgaagccttcggagaccctgtccctcacctgcgctgtctctggtgggtccttaagtggttcctactggacctggatccgccagcccccagggcagggactggagtggattggggaaatcattcatagtggaagcaccaactacaacccgtccctcaagagtcgagtcaccatatcagtagacacgtccaggaaccagttctccctgaagctggcctctatgaccgccgcagacacggctatttattactgtgcgagaggcctttggattggcggcagctggtatgactactggggccagggaaccctggtcaccgtctcctca

SEQ ID NO: 4630 - DNA, 321 bp, Homo sapiens
gacatccagatgacccactctccatcctccctgtctgcatctgtaggcgacagagtcaccatcacttgccggacaagtcagaacattagaacctatttaaactggtatcagcagagaccagggaaggcccctaaactcctgatctctgctgcatccaatttacatagtggggtcccatcaaggttcagtggcagtggatctgggacagatttcactctcaccgtcagcagtctgcaacctgaagattttgcaacttactattgtcaacagagttacagtatcccgtacacttttggccaggggaccaagctggagatcaaa

SEQ ID NO: 4631 - DNA, 363 bp, Homo sapiens
gaggtgcagctgttggagtctgggggaggcttggtacagcctggggggtccctgagactctcctgtgcaccctctggattcacctttagcagctatgccatgaactgggtccgccaggctccagggaaggggctggagtgggtctcaactattagttatactggtggtaacacattctacgcaaactccgtgaagggccggttcaccatctccagagacaattccaagaacacactgtatctgcaaatgaacagcctgagagtcgaggacacggccgtatattactgtgcgaaagccaccactatggttcagggagtcgactttgactactggggccagggaaccctggtcaccgtctcctca

SEQ ID NO: 4632 - DNA, 321 bp, Homo sapiens
gacatccagatgacccagtctccatcctccctgtctgcatctgtaggagacagagtcaccatcacttgccgggcaagtcagagcgttagcagctatttaaattggtatcaacagaaaccagggaaagcccctaaactcctgatctatgctgcatccagtttgcaaagtggggtcccatcaaggttcagtggcagtggatctgggacagatttcactctcaccatcagcagtctgcaacctgaagattttgcaacttactactgtcaacagagttacagtcccccggtcactttcggcggagggaccaaggtggagatcaaa

SEQ ID NO: 4633 - DNA, 363 bp, Homo sapiens
cagctgcagctgcaggagtcgggcccaggactggtgaagccttcggagaccctgtccctcacctgcactgtctctggtggctccatcagcagtagtacttcctactggggctggatccgccagcccccagggaagggactggagtggattgggactatctattatactgggagcacctactacaacccgtccctcaagagtcgagtcaccatatcagtagacacgtccaagaaccagttctccctgatgctgacctctgtgaccgccgcagacacggccgtctattactgtgcgagagattcattggacttatccctgctctttgactactggggccagggaaccctggtcaccgtctcctca

SEQ ID NO: 4634 - DNA, 333 bp, Homo sapiens
caggttgtgctgactcaatcgccctctgcctctgcctccctgggagcctcggtcaagctcacctgcactctgagcagtgggcacagcgggtacgccatcgcatggcatcagcagcagccagagaagggccctcggtacttgatgaggcttaacagtgatggcagccacagcaagggggacgggatccctgatcgcttctcaggctccagctctggggctgagcgctacctcaccatctccagcctccagtctgaggatgaggctgactattactgtcagacctggggcactggcattcgggtattcggcggagggaccaagctgaccgtccta

SEQ ID NO: 4635 - DNA, 408 bp, Homo sapiens
gaggtgcagctggtggagtctgggggaggcttggtaaagccagggcggtccctgagactctcctgttcatcttctggattcacctttcgtgattatgctatgacctggtttcgccaggctccagggaaggggctggagtgggtaggtttcattagaagtaaagcttatggtgggacaacagaatacgccgcgtctgtgaaagacagattcaccatctcaagagatgattccaaaagcatcgcctatctgcaaatgaacagcctgaaaaccgaggacacagccgtgtattattgtagtagatcgaaacctttgtattactctggttcggggacttcttataagggggaagaatacgactactacggtatggacgtctggggccaagggaccacggtcaccgtctcctca

SEQ ID NO: 4636 - DNA, 321 bp, Homo sapiens
gacatccagttgacccagtctccatccttcctgtctgcatctgtaggagacagagtcaccatcacttgccgggccagtcagggcgttagcagttatttagcctggtatcagcaaaaaccagggatggcccctaagctcctgatctatgctgcatccattttgcaaagtggggtcccctcaaggttcagcggcagtggatctgggacagaattcaccctcacaatcaccagcctgcagcctgaagattttgcaacttattactgtcaacagcttaatagttaccctcgaactttcggccctgggaccaaagtggatatcaac

SEQ ID NO: 4637 - DNA, 363 bp, Homo sapiens
gaggtccagctggtacagtctggggctgaggtgaagaagcctggggctacagtgaaaatctcctgcagggtttctggatacaccttcaacgactactacatccactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatatgaagacacggccgtgtattactgtgcaacagatatcgattgtactggtggtagctgctacccttactggggccagggaaccctggtcaccgtctcctca

SEQ ID NO: 4638 - DNA, 321 bp, Homo sapiens
gacatccagatgacccagtctccatcctccctgtctgcatctgtaggagacagagtcaccatcacttgccgggcaagtcagggcattagaaatgatttaggctggtatcagcagaaaccagggaaagcccctaagcgcctgatctttgctgcatcctttttgcaaagtggggtcccatcaaggttcagcggcagtggatctgggacagaattcactctcacaatcagcagcctgcagcctgaagattttgcaacttattactgtctacagcataatagttaccctctgacgttcggccaagggaccaaggtggaaatcaaa

SEQ ID NO: 4639 - DNA, 351 bp, Homo sapiens
caggtgcagctggtggagtctgggggaggcgtggtccagcctgggaggtcccggagactctcctgtgcagcctctggattcaccttcagtagctatgctatgcactgggtccgccaggctccaggcaagggactggagtgggtggcacttatatcatatgatggaagtaataaatactacgcagactccgtggtgggccgattcaccatctccagagacaattccaagaacacgttgtatctgcaaatgagcagcctgagacctgaggacacggctgtgtattactgtgcgagagcccaagcggacggtatggacgtctggggccaagggaccacggtcaccgtctcctca

SEQ ID NO: 4640 - DNA, 318 bp, Homo sapiens
tcctatgagctgactcaggcaccctcagtgtccgtgtccccaggacagacagccatcatcccctgctctggagataaattgggggataaatatgcttcctggtatcagcagaagccaggccagtcccctgtgctggtcatctctcaagataccaagcggccctcagggatccctgaccgattctctggctccaactctgggaacacagccactctgaccatcagcgggacccaggctatggatgaggctgactattactgtcaggcgtgggacagcagaactgcggtattcggcggagggaccaagctgaccgtccta

SEQ ID NO: 4641 - DNA, 366 bp, Homo sapiens
gaagtgcaactcgtggagtctgggggagtcgtggtacagcctggggggtccctgagactctcctgtgcagcctctggattcacttttgatgattatgccatgcactgggtccgtcaagctccggggaagggtctggagtgggtctctcttattacttgggatggtggtagcacatactatccagactctgtgaagggccgattcaccatctccagagacaacagcaaaaactccctatatctgcaaatgaacagtctgagaactgaggacaccgccttttattactgtgcaaaagatataggtaatagtcctgctggtaactccttctctgagtggggccagggaaccctggtcaccgtctcctca

SEQ ID NO: 4642 - DNA, 327 bp, Homo sapiens
gaaattgtgttgacacagtctccagccaccctgtctttgtctccaggggaaagagccaccctctcctgcagggccagtcagagtgttagtacctacttagcctggtaccaacagaaatctggccaggctcccaggctcctcatctttgatgcatccagcagggccactggcatcccagccaggttcagtggcagtgggtctgggacagacttcactctcaccatcagcagcctagagcctgaagattttgcagtttatttctgtcagcagcgtagcatctggcctccggaattcactttcggccctgggaccaaagtggatctcaaa

SEQ ID NO: 4643 - DNA, 384 bp, Homo sapiens
caggtcaccttgagggagtctggtcctgcgctggtgaaacccacacagaccctcacactgacctgcaccttctctgggttctcactcagcactagtggaatgtgtgtgagctggatccgtcagcccccagggaaggccctggagtggcttgcactcattgattgggatgatgataaatactacagcacatctctgaagaccaggctcaccatctccaaggacacctccaaaaaccaggtggtccttacaatgaccaacatggaccctgtggacacagccacatattactgtgcacggatgcctgtagacatgtctaccgtcggggggtactactattacggtatggacgtctggggccaagggaccacggtcaccgtctcctca

SEQ ID NO: 4644 - DNA, 330 bp, Homo sapiens
cagtctgtgctgactcagccaccctcagcgtctgggacccccgggcagagggtcaccatctcttgttctggaagcagctccaacatcggaaataattatgtatactggtaccagcacctcccaggaacggcccccaaactcctcatctataaaaataatcagcggccctcaggggtccctgaccgattctctggctccaagtctggcacctcagcctccctggccatcagtgggctccggtccgaggatgaggctgattattactgtgcagcatgggatgacaccctgaatacttgggtgttcggcggagggaccaagctgaccgtccta

SEQ ID NO: 4645 - DNA, 348 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaggtattagtgctggtggtggtagcacatactacgcagactccgtgaagggccggttcaccatctccagagacaattccaagaacacgctgtatctgcaaatgaacagcctgagagccgaggacacggccgtatattactgtgcgaaaggaggtgactacggggtctactggggccagggaaccctggtcaccgtctcctca

SEQ ID NO: 4646 - DNA, 318 bp, Homo sapiens
tcctatgagctgacacagccaccctcggtgtcagtgtccccaggacagacggccaggatcacctgctctggagatgcattgccaaagcaatatgcttattggtaccagcagaagccaggccaggcccctgtactggtgatatataaagacagtgagaggccctcagggatccctgagcgattctctggctccagctcagggacaacagtcacgttgaccatcagtggagtccaggcagaagacgaggctgactattactgtcaatcagcagacagcagtggttgggtgttcggcggagggaccaagctgaccgtccta

SEQ ID NO: 4647 - DNA, 360 bp, Homo sapiens
gaggtgcagctggtgcagtctggagcagaggtgaaaaagcccggggagtctctgaagatctcctgtaagggttctggatacagctttaccgactactggatcgcctgggtgcgccagatgcccgggaaaggcctggagtggatggggatcatctatcctgatgactctgataccagatacagcccgtccttcgaaggccaggtcaccatctcagccgacaagtccatcagcaccgcctacctgcagtggagtaggctgaaggcctcggacaccgccatgtattactgtgggagactaacgggtcaggtgttgtggggctttgactactggggccagggaaccctggtcaccgtctcctca

SEQ ID NO: 4648 - DNA, 324 bp, Homo sapiens
gaaattgttttgacgcagtctccaggcaccctgtctttgtctccaggggaaagagccaccctctcctgcagggccagtcagagtgttagcagcaactacttagcctggtaccagcagaaacctggccaggctcccaggctcctcatctatggtgtatccaggagggccactggcatcccagacaggttcagtggcagtgggtctgggacagacttcactctcaccatcagcagactggagcctgaagattttgcagtgtattactgtcagcattatggtagctcacgaggaacgttcggccaagggaccaaggtggaaatcaaa

SEQ ID NO: 4649 - DNA, 381 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaggtattagtgatagtggtggtagcacatactacgcagactacgtgaagggccggttcaccatctccagagacaattccaaggacacgctgtatctgcaaatgaacagcctgagagccgaggacacggccgtatattactgtgcgaaagatcgggggaacgagtacgccctgacccactactactactacgctatggacgtctggggccaagggaccacggtcaccgtctcctca

SEQ ID NO: 4650 - DNA, 321 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatacagtttgcaaagtggggtcccatcaaggttcagtggcggtggatctgggacagatttcactctcaccatcagcagtctgcaacctgaagattttgcaacttacttctgtcaacagagttacagtaccccgatcactttcggccaagggacacgactggagattaaa

SEQ ID NO: 4651 - DNA, 366 bp, Homo sapiens
caggtgcagctggtgcagtctggggctgaggtgaggaagcctggggcctcagtgacggtttcctgcaaggcatctggagacaccttcaccaactactatatgcactgggtgcgacaggcccctggacaaggagggcttgagtggttgggagtaatcaaccctagtggtgatagcacaaggttcgcacagagataccagggcagagtcaccatgaccagggacacgtccacgagcacaatctacatggcgctgagcagtctgagatctgaggacacggccgtatattactgtgcgagagtgtacgatatgtttgggtacaactggttcgacccctggggccagggaaccctggtcaccgtctcctca

SEQ ID NO: 4652 - DNA, 333 bp, Homo sapiens
cagtctgtgctgacgcagccgccctcagtgtctggggccccagggcagagggtcaccatctcctgcactgggagcagctccaacatcggggcaggttatgatgttcactggtaccagcagcttccaggaacagcccccaaactcctcatctatggtaacagcaatcggccctcaggggtccctgcccgattctctggctccaagtctggcacctcagcctccctggccatcactgggctccaggctgaggatgaggctgattattactgccagtcctatgacaacagcctgagtggtgtggttttcggcggagggaccaagctgaccgtccta

SEQ ID NO: 4653 - DNA, 366 bp, Homo sapiens
caggtgcagctggtggagtctgggggaggcgtggtccagcctgggaggtccctgagactctcctgtgcagcgtctggattcaccttcagtaactatggcatgcactgggtccgccaggctccaggcaaggggctggagtgggtggcagttatatggtttgatggaagtaataaattctatgcagactccgtgaagggccgattcaccatctccagagacaattccaaggacacgctgtatctgcaaatgaacagcctgagagccgaggacacggctgtctattactgtgcgaaagatggacttcccttccgcatacaattatggactgactactggggccagggatccctggtcaccgtctcctca

SEQ ID NO: 4654 - DNA, 321 bp, Homo sapiens
gacatccagatgacccagtctccatcttccgtgtctgcatctgtaggagacagagtcaccatcagttgtcgggcgagtcagggtattagcacctggttagcctggtatcagcacaaagcagggaaagcccctaagctcctgatctatgatgcatccagtttgcaaagtggggtcccatcaaggttcagcggcagtggatctgggacagatttcactctcagcatcagcagtctgcagcctgaagattttgcaacttactattgtctacagtctaccagtttccctccgactcttggccaggggaccaagctcgagatcaaa

SEQ ID NO: 4655 - DNA, 381 bp, Homo sapiens
caggtgcgactggtggagtctgggggaggcgtggtccagcctgggaggtccctgagactctcctgtgcagcctctggactcaccttcagaaactatggcatgtattgggtccgccaggctccaggcaaggggctggagtggatggcagttatatcatatgatggagatgataaatactatgcagactccgtgaagggccgattcaccatctccagagacaattccaagaacacactgtatctgcaaatgaacagcctgagagctgaggacacggctgtgtattactgtgcgaaagcctctgggccatattgtagtggtggtagctgctaccgggctgccttagactactggggccagggaaccctggtcaccgtctcctca

SEQ ID NO: 4656 - DNA, 321 bp, Homo sapiens
gacatccagatgacccagtctccatcctccctgtctgcatctgtaggagacagagtcaccatcacttgccaggcgagtcaggacattagcaactatttaaattggtatcagcagaaaccggggaaagcccctaagctcctgatctacgagacatccaatttggaaacaggggtcccatcaaggttcagtggaagtggatctgggacagattttactttcaccatcagcagcctgcagcctgaagatattgcgacatattactgtcaacaatatgatggtctcccgctcactttcggcggagggactaaggtggatatcaaa

SEQ ID NO: 4657 - DNA, 387 bp, Homo sapiens
caggtacagctgcagcagtcaggtccaggactggtgaagccctcgcagaccctctcactcacctgtgccatctccggggacagtgtctctagcaaccatgttgcttggaactggatcaggctgtccccatcgagaggccttgagtggctggggaggacatactacaggtccaagtggtataatgattatgcagtatctgtgaaaagtcgaatgagtatcagcccagtcacatccaagaaccagttctccctgcagttgaactctgtgactcccgaggacacggctgtgtatttctgtgcaagagatcttttagtggtgggtatagcagcagctggtaatcactggttcgacccctggggccagggaaccctggtcaccgtctcctca

SEQ ID NO: 4658 - DNA, 333 bp, Homo sapiens
cagtctgtgctgactcagccaccctcagcgtctgggacccccgggcagagggtcaccatctcttgttctggaagcaccttcaacatcggaagtaatactgtaaactggtaccagcagctcccaggaacggcccccaaactcctcatctgttgtaataatcagcggccctcaggggtccctgaccgattctctggctccaagtctggcacctcagcctccctggccatcagtgggctccagtctgaggatgaggctgattattactgtgcagcatgggatgacagcctgaatgggttttatgtcttcggaactgggaccaaggtcaccgtccta

SEQ ID NO: 4659 - DNA, 360 bp, Homo sapiens
caggtgcagctggtggagtctgggggaggcgtggtccagcctgggaggtccctgagactctcctgtgcagcctctggatccaccttcagtagttatgctatgcactgggtccgccaggctccaggcaaggggctgcagtgggtggcagttatttcatttgatggcagcaataaatactatgcagactccgtgaagggccgattcaccatctccagagacaattccaagaacacgctgtatctgcaaatgaacaacctgagacctgttgacacggctgtgtattactgtgcgagagaccgtacatcaatggctggtccttttgactactggggccagggaaccctggtcaccgtctcctca

SEQ ID NO: 4660 - DNA, 318 bp, Homo sapiens
tcctatgaactgactcagccaccctcagtgtccgtgtccccaggacagacagccagcatcacctgctctggagataaattgggggataaatatgtttactggtatcagcagaagacaggccagtcccctctgctggtcatctatcgagataccacgcggccctcagggatccctgagcgcttctctggctccaactctgggaacacagccactctgaccatcagcgggacccaggctatggatgaggctgactattactgtcaggcgtgggacagcagcgctgtggtattcggcggagggaccaagctgaccgtccta

SEQ ID NO: 4661 - DNA, 345 bp, Homo sapiens
caggtgcagctgcaggagtcgggcccaggactggtgaagccttcggagaccctgtccgtcacctgcactgtctctggtgactccatcagtggttacttctggagctggctccggcagcccccaggtaagggactggagtggattggccatatctattacagtgggagcagtgggagcaccaactacaacccctccctcaagagtcgagtcaccatatcagtagacacgtccaagaaccagttctccctgaagctgagctctgtgaccgctgcggacacggccgtctattactgtgcgagaggattcgacccctggggccagggaaccctggtcatcgtctcctca

SEQ ID NO: 4662 - DNA, 324 bp, Homo sapiens
gaaattgtgttgacgcagtctccaggcaccctgtctttgtctccaggggaaatagccaccctctcttgcagggccagtcagagtgttagcagcagctacttagcctggtaccagcagaaacttggccaggctcccaggctcctcatctatgctgcatccagcagggccattggcatcccagacaggttcagtggcagtgggtctgggacagacttcactctcaccatcagcagactggagcctgaagattttgcagtgtattactgtcagcagtatggtagctcaccttggacgttcggccaagggaccaaggtggaaatcaaa

SEQ ID NO: 4663 - DNA, 366 bp, Homo sapiens
gaggtgcagttggtggagtccgggggcggcttggtccagcctggggggtccctcaaagtctcctgtgcagcccatgggttcaccttcagtggctctgctatccactgggtccgccaggctcccgggaaaggactggagtgggttgcccgtatcagaaccaaagtgaacaactacgcgactgcatatactacgtcggtgcaaggcaggttcaccgtctccagagatgactcaaagaacacggcctatctggaaatgaacagattgaaaatcgaggacacggccgtatatttctgcactagacttcacccaacagtggaacgactctttgactattggggccagggaaccctcgtcaccgtctcctca

SEQ ID NO: 4664 - DNA, 330 bp, Homo sapiens
cagtctgtgctgactcagccaccctcagcgtctgggacccccgggcagagggtcaccctctcttgttctggaagcaactccaacatcggaactaactatggaaactggtatcagcaactcccaggagcggcccccaaactcctcatctataagaatgatcagcggccctcaggggtccctgaccgattctctggctccaagtctggcacctcagcctccctggccatcagtgggctccggtccgaggatgaggctgattactactgtgcaacatgggatgacagactgagacgttgggtcttcggcggagggaccaagctgaccgtccta

SEQ ID NO: 4665 - DNA, 393 bp, Homo sapiens
caggtgcagctggtggagtctgggggaggcgtggtccagcctgggaggtccctgagactctcctgtgcagcctctggatttaccttcagtagctatgctatgcactgggtccgccaggctccaggcaaggggctggagtgggtggcagttatatcatatgatggaagcaataaatactacacagactccgtgaagggccgattcaccatctccagagacaattccaagaacacactgtatctgcaaatgaacagcctgagacctgaggacacggctgtgtattactgtgcgagagatcggttgttctatgatggtagtggttattacctccaagccttctaccagtacggaatggacgtctggggccaagggaccacggtcaccgtctcctca

SEQ ID NO: 4666 - DNA, 327 bp, Homo sapiens
gccatccagttgacccagtctccatcctccctgtctgcatctgtaggagacagagtcaccatcacttgccgggcaagtcagggcattagcagtgctttagcctggtatcagcagaaaccaggaaaagctcctaaactcctgatctatgatgcctccactttggaaagtggggtcccatcaaggttcagcggcagtggatctgggacagatttcactctcaccatcagcagcctgcagcctgaagattttgcaacttattactgtcaacagtttaataattaccctcccctattcactttcggccctgggaccaaagtggatctcaaa

SEQ ID NO: 4667 - DNA, 381 bp, Homo sapiens
caggtgcagctgcaggagtcgggcccaggactggtgaagccttcacagaccctgtccctcacctgcactgtctctggtggctccatcagcagtggtagttacttctggagctggatccggcagcccgccgggaagggactggagtggattgggcgtatctataccagtgggaacaccaattacaatccctccctcaagagtcgagtcaccatatcagtagacacgtccaagaaccagttctccctgaagctgagctctgtgaccgccgcagacacggccgtgtattactgtgcgagatacgaatcaagtattacgatttttggagtggcccactacggtatggacgtctggggccaagggaccacggtcaccgtctcctca

SEQ ID NO: 4668 - DNA, 324 bp, Homo sapiens
gaaattgtgttgacgcagtctccaggcaccctgtctttgtctccaggggaaagagccaccctctcctgcagggccagtcagactgttagcagcggctacttagcctggtaccagcagaaacctggccaggctcccaggctcctcatttatggtgcatccagcagggccactggcatcccagacagtttcagtggcagtgggtctgggacagacttcactctcaccatcagcagactggagcctgaagattttgcgatgtattactgtcagcagtatggtaggttaccgctcactttcggcggagggaccaaggtggagatcaaa

SEQ ID NO: 4669 - DNA, 354 bp, Homo sapiens
gaggtgcacctggtggagtctgggggaggcttaataaagcctggggggtcccttagactctcctgtgcagcctctggattcactttcagtaacgcctggatgagctgggtccgccaggctccagggaaggggctggagtgggttggccgtattaaaagcaaaaataatggtgggacagcagactacactgcacccgtggcaggcagattcaccatgtcaagagatgattcagaagacacgctggatctgcaaatgaacagccttaaaaccgaggacacaggtgtttattactgtaccacagggtggaactacggggcctcctggggccagggaaccctggtcaccgtctcctca

SEQ ID NO: 4670 - DNA, 321 bp, Homo sapiens
gaagttgtgttgacacagtctccagccaccctgtctttgtctccaggggaaagagccaccctctcctgcagggccagtcagagtgttagcagtaatttagcctggtaccaacagaaacctggccaggctcccaggctcctcatctttgatgcatccaacagggccactgacatcccagccaggttcagtggcagtgggtctgggacagacttcactctcaccatcagcagcctagagcctgaagattttgcagtttattactgtcagcagcgtggcaactggccgctcactttcggcggagggaccaaggtggagatcaaa

SEQ ID NO: 4671 - DNA, 372 bp, Homo sapiens
caggtgcagctgcaggagtcgggcccaggactggtgaagccttcacagaccctgtccctcacctgcactgtctctggtggctccatcaaaagtgctgattactactggagctggatccgccagcacccagggaagggcctggagtggattgggtacatctattacagtgggagcacgtactacaacccgtccctcaggagtcgacttaccatatcagtagacacgtctaagagccagttctccctgaagctgagctctgtgactgccgcggacacggccgtgtattactgtgcgagagtgagaggatattgtagtagtaccaagtgccatgttgactactggggccagggaaccctggtcaccgtctcctca

SEQ ID NO: 4672 - DNA, 327 bp, Homo sapiens
gaatttgtgttgacacagtctccaaccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcgactggcctccggggatcaccttcggccaggggacacgactggaggttaaa

SEQ ID NO: 4673 - DNA, 357 bp, Homo sapiens
gaggtgcagctggtggagtctgggggaggcttggtaaagcctggggggtcccttagactctcctgtgcagcctctggattcactttcagtaatgcctggatgagctgggtccgccaggctccagggaaggggctggagtgggttggtcgtattaaaagcaaaagtgatggtgggacaacagactacgctgcacccgtgaaaggcagattcaccatctcacgagatgattcaaaaaacacactctatttgcaaatgaacagtctgaaaaccgaggacacagccgtatattactgtgagcgcggcggcatctggtatttagactggtggggccagggaaccctggtcaccgtctcctca

SEQ ID NO: 4674 - DNA, 327 bp, Homo sapiens
cagtctgtgctgactcagccaccctcagcgtctgggacccccgggcagagggtcaccatctcttgttctggaagcagctccaacatcggaagtaattatgtttactggtaccagcagctcccaggaacggcccccaaactcctcatctataggaatagtcagcggccctcaggggtccctgaccgattctctggctccaagtctggcacttcagcctccctggccatcagtgggctccggtccgaggatgaggctgattattactgtgcagcatgggatgacagcctgagacgggtgttcggcggagggaccaagctgaccgtccta

SEQ ID NO: 4675 - DNA, 375 bp, Homo sapiens
caagtccaactggtgcagtctggggctgaggtgaagaagcctgggtcctcggtgaaagtctcctgcaaggcttctggagacactttcagcaattatgctatcagttgggtgcgacaggtccctggacaagggcttgagtggatgggaaggatcatccctatcgttggtatagcaaactacgcacagaagttccggggcagagtcacgattaccgcggacacatccactaacacagcctacatggaactgagcagcctgagatctgaggacacggccgtatattattgtgggaaactctttggggggaggcctcaacatcccccgccttccaggtttgacttctggggccagggaaccctggtcaccgtctcctca

SEQ ID NO: 4676 - DNA, 336 bp, Homo sapiens
gaaattgtgatgactcagtctccaatcaccctgcccgtcacccctggagagccggcctccatctcctgcaggtctagtcagagcctcctgcatagtaatggatacaattatgtggattggtacttagagaagccagggcagtctccacagctcctgatctatttgggttctaatcgggcctccggggtccctgacaggttcagtggcagtggatcaggcacagattatacactcaaaattagcagagtggaggctgaggatgttggggtttattactgcatgcaagttttacaaactcctctctctttcggcggagggaccaaggtggagatcaaa

SEQ ID NO: 4677 - DNA, 381 bp, Homo sapiens
caggtccagctggtgcaatctggggctgaggtgaagaagcctgggtcctcggtgaaggtctcctgcaaggcttctggaggcaccttcagcagctacactttcagctgggtgcgacaggcccctggacaagggcttgagtggatgggaaggatcatccctatccttggtataacaaactacgcacagaagttccagggcagagtcacgattaccgcggacaaatccacgagcacagcctacatggagctgagaagcctgagatctgaggacacggccgtgtattactgtgcgatagatacgtattactatgatagtagtggtctatatacggaggagacaattgaccgctggggccagggaaccctggtcaccgtctcctca

SEQ ID NO: 4678 - DNA, 339 bp, Homo sapiens
gacatcgtgatgacccagtctccagcctccctgtctgtgtctctgggcgagagggccaccatcaactgcaagtccagtcagagtgttttacacagctccaacaataagtaccacttagcatggtaccagcagaaaccaggacagccccctaaggtgctcatttactgggcatctacccgggagtccggggtccctgaccgattcagtggcagcgggtctgggacagatttcactctcaccatcagcagcctgcaggctgaggatgtggcagtttattactgtcagcaatattatagtactcctctcactttcggcggagggaccaaggtggagatcaag

SEQ ID NO: 4679 - DNA, 363 bp, Homo sapiens
gaggtgcagctggtgaattctgggggaggcctggtcaggcctggggggtccctgagactctcctgtgcagcctctggattcattttcagtgattatagcatcaactgggtccgccagtctccaggaaaggggctggagtgggtctcatccattagtagtagaagtaatttcacatatttcgcagactcagtggagggccgcttcaccgtgtccagagacaacgccaagaagtcactgtttctgcacatgaacagcctgagagtcgaggacacggctgtttattactgtgcgagagatagggtcgggcggggccgggaggctcttgacatctggggccaagggacaatggtcaccgtctcttca

SEQ ID NO: 4680 - DNA, 321 bp, Homo sapiens
gacgtccagttgacccagtctccttccaccctgtctgcatatgtaggagacagggtcaccatcacttgccgggccagtcagggtatcactaggtggttggcctggtatcaacagaaaccagggaaaccccctaagctcctgatctacaaggcgtctaccttagaaactggcgtcccgtcaaggttcagcggcactggatttgggacagaattcactctcaccattagcaacctgcagcctgatgattttgcaacttattactgccaacagtatgataattatcagtacacttttggccaggggaccaagctgcagatcaga

SEQ ID NO: 4681 - DNA, 354 bp, Homo sapiens
caggtgcagctggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttggcttctccttggacacctctgccaacacggcatatctgcagatcagcagcctaaaggctgcggacactgccgtgtattactgtgggagacttcggggccctggggcttttgatatctggggccaagggacaatggtcaccgtctcttca

SEQ ID NO: 4682 - DNA, 321 bp, Homo sapiens
gacatccagatgacccagtctccatcctccctgtctgcatctgtaggagacagagtcaccatcacctgccaggcgagtcaagacattagcaactatttaaattggtatcagcagaaaccagggaaagcccctaagctcctgatctacgctgcatccaatttggaaacaggggtcccatcaaggttgagtggagttggatctgggacacattttactttcaccatcagcagcctgcagcctgaagatattgcaacatattactgtcaacaatattctaatctcccgatcaccttcggccaagggacacgactggagattaaa

SEQ ID NO: 4683 - DNA, 363 bp, Homo sapiens
caggtgcagctggtggagtctgggggaggcgtggtccagcctgggaggtccctgagactctcatgtgcagcctctggattcaccttcagtagctatgctatgcactgggtccgccaggctccaggcaaggggctggagtgggtggcagttatatcatatgatggaagcaataaatactacgcagactccgtgaagggccgattcaccatctccagagacaattccaagaacacgctgtatctgcaaatgaacagcctgagagctgaggacacggctgcatattactgtgcgagagtggggggtgggagctatttcggggggtttgactactggggccagggatccctggtcaccgtctcctca

SEQ ID NO: 4684 - DNA, 315 bp, Homo sapiens
gacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgatcttgcaacttattactgccaacagtttaaaagttattcgttcggcgaagggaccaaggtggaaatcaaa

SEQ ID NO: 4685 - DNA, 363 bp, Homo sapiens
caactgcaactacaggagtcgggcccaggaccggtgaggccttcggagaccctgtccctcaactgcactgtctctggcggctccatcagcagtagtggttattactggggctgggtccgccagtccccagggaaggggctggaatggattgggagcatctattatagtgggaggacctccaacaatccgtccctcaagagtcgagtcaccatatccatagacaggtccaagaaccagttctccctgagtctgggctctgtgaccgccgcagacacggctgtctattactgtgcgcggcagggatatatgcacattccttattgggacttctggggccagggagccctggtcaccgtctcctca

SEQ ID NO: 4686 - DNA, 321 bp, Homo sapiens
gacatccagatgacccagtctccatcctccctgtctgcatctgtaggcgacagagtcaccttcacttgccgggcaagtcagagcattagcacctatttaaattggtatcagcagcatccagggaaagcccctagactcctgatctatgctgcatcccatttgcaaagtggggtcccattaaggttcagtggcagtggatctgggacagatttcactctcgccatcagcagtctccaacctgaagattttgcaacttacttctgtcaacagacttacagtacccctcaaacttttggccaggggaccaagctggagatcaac

SEQ ID NO: 4687 - DNA, 357 bp, Homo sapiens
caggtccaacttgtgcagtctggggctgagctgaagaagcctggggcctcagtgaacatttcctgcaaggcttctggatatgtcttcactaactattttatacactgggtgcgccaggcccccggacagaggcctgagtggatgggatggatcaacacagacactggtaaaactaaatattcacagaacttacagggcagaggcaccattaccagggagacatccgcgagcacagcctacatggacctgagcagcctgagaaatgaagacacggctgtctactactgtgcgagagcagagagagccagtggccgcttcccttactggggccaggggaccctggtcaccgtctcctca

SEQ ID NO: 4688 - DNA, 321 bp, Homo sapiens
gacatccagatgacccagtctccttccaccctgtctgcatctgtaggagacagagtcaccatcacttgccgggccagtcagagtattagtgggtggttggcctggtatcagcagaaaccaggggaagtccctaagatcctaatatatagggcgtctagtttagaaagtggggtcccatcaagattcagcggcagtggatctgggacacaattcactctcaccatcaacagcctgcagcctgatgattttgcaacttattattgccaacagtataatggttatccgtacacttttggccaggggaccaagctggagatcaaa

SEQ ID NO: 4689 - DNA, 375 bp, Homo sapiens
gaagtgcagctggtggagtctgggggaggcttggtacagcctggcaggtccctgagactctcctgtgcagcctctggattcacgtttgatgatcatgccatgcactgggtccggcaagctccagggaagggcctggagtgggtctcaggtattagttggaatagtggtaggataggctatgcggactctgtgaagggccgattcaccatctccagagacaacgccaagaactccctgtatctgcaaatgaacagtctgagagctgaggacacggccttgtattactgtgtaaaagatattaggaggtatagcagtggcttcgggtattacggtttggacgtctggggccaagggaccacggtcaccgtctcctca

SEQ ID NO: 4690 - DNA, 330 bp, Homo sapiens
cagtctgtgttgacgcagccgccctcaatgtctgcggccccaggacagaaggtcaccatctcctgctctggaagcagctccaacattgggagtaattatgtatcctggtaccagcaggtcccaggaacagcccccaaactcctcatttatgacaataataagcgaccctcagggattcctgaccagttctctggctccaagtctggcacgtcagccaccctggacatcaccggactccagactggggacgaggccgattattactgcggaacatgggatagcagcctgagtgctgtggtattcggcggagggaccaagctgaccgtccta

SEQ ID NO: 4691 - DNA, 378 bp, Homo sapiens
caggtgcagctgcgggagtcgggcccaggactggtgaagccttcacagaccctgtccctcacctgcactgtctctggtggctccatcagcagtgataattactactggagctggatccggcagcccgccgggaagggactggagtggattgggcgtatccataccagtgggagcaccaactacaacccctccctcaagagtcgagtcaccatatcagcagacacgtccaagaaccagttctccctgaagctgaactctgtgaccgccgcagacacggccgtgtattactgtgcgagagatgttactctgatcgtcgtggttcatagggggggctggttcgacccctggggccagggaaccctggtcaccgtctcgtca

SEQ ID NO: 4692 - DNA, 330 bp, Homo sapiens
cagtctgtgctgacgcagccgccctcagtgtctggggccccagggcagagggtcaccatctcctgcactgggagcagctccaacatcggggcaggttatgatgttcactggtaccagcagcttccaggaacagcccccaaactcctcatctatgctaacagcaatcggccctcaggggtccctgaccgattctctggctccaagtctggcacctcagcctccctggccatcactgggctccaggctgcggatgaggctgattattactgccagtcctatgacagcagcctgaggggtgtattcggcggagggaccaagctgaccgtccta

SEQ ID NO: 4693 - DNA, 357 bp, Homo sapiens
caggtgcagctggtgcagtctggggctgaggtgaagaagcctggggcctcagtgaaggtttcctgcaaggcatctggatacaccttcatcaactactatgtgcactgggtgcgacaggcccctggacaagggcttgagtggatgggaatgatcaatcctagtggtgacggcacaagttacgcacagaggttccagggcagagtcaccatggccagcgacacgtccacgacaacagtctacatgtctttgaacagcctgagatttgaggacacggccatgtattactgtgcgagaggggcgacggtggcacgcatcattgagtattggggccagggaaccctggtcaccgtctcctca

SEQ ID NO: 4694 - DNA, 321 bp, Homo sapiens
gacatccagatgacccagtctccatcttctgtgtctgcatctgtaggagacagagtcaccatcacttgtcgggcgagtcaggttattggcagctggttagtctggtatcagcagaaagcagggaaagcccctaacctcctgatctacggtgcatccaatttgcaaagtggggtcccatcaaggttcagcggcagtggatctgggacagatttcactctcactatcagtaacttgcagcctgaagattttgccacttactattgtcaacaggctaacagtttcccgctcactttcggcggagggaccaaggtggagatcaaa

SEQ ID NO: 4695 - DNA, 378 bp, Homo sapiens
caggtgcagctggtggagtctgggggaggcgtggtccagcctgggaggtccctgagactctcctgtgcagcctctggattcaccttcagtaactatggcatgcactgggtccgccaggctccaggcaaggggctggaatgggtggcagttatatcatatgatggaactaatgaatactatgcagactccgtgaagggccgattcaccatctccagagactattccaagaactcgctgtttctgcaaatgaacagcctgagacctgaggacacggctgtgtattactgtgcgaaagatctacgagttttggagtggttacccccctcttactacgatatggatgtctggggccaagggaccacggtcaccgtctcctca

SEQ ID NO: 4696 - DNA, 330 bp, Homo sapiens
cagtctgccctgattcagcctgcctccgtgtctgggtctcttggacagtcgctcaccatctcctgcactggaaccagcagtgacgttggtgcttataactatgtctcctggtaccaacagttcccaggcagagtccccaaactcatgatttatgaggtcagtaatcggccctcaggggtttctagtcgcttctctggctccaggtctggcaacacggcctccctgaccatctctgggctccaggctgaggacgaggctgattattactgctgctcatatacaagtagcagcactggagtcttcggaactgggaccaaggtcaccgtccta

SEQ ID NO: 4697 - DNA, 363 bp, Homo sapiens
caggtgcagctggtggagtctgggggaggcttggtcaagcctggagggtccctgagactctcctgtgcagcctctggattcaccttcagtgactactacatgagctggatccgtcaggctccagggaaggggctggaatgggtttcatacattagtagtagtggtaataccatatattacgcagactctgtgaagggccgattcaccatctccagggacaacgccaagaactcactatatctactaatgaacagcctgagagtcgaggacacggccgtgtattactgtgcgagagatcggttgtgggtcgttcgtggtgagattgactactggggccagggaaccctggtcaccgtctcctca

SEQ ID NO: 4698 - DNA, 330 bp, Homo sapiens
cagtctgccctgactcagcctgcctccgtgtctgggtctcctggacagtcgatcaccatctcctgcactggaaccagcagtgatgttgggagttataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggttttaccacttatgtcttcggaactgggaccaaggtcaccgtccta

SEQ ID NO: 4699 - DNA, 384 bp, Homo sapiens
gaggtgcagctggtggagtccgggggaggcttagttcagccgggggggtccctgagactctcctgtgcagcctctggattcaccttcagtagctactggatgcactgggtccgccaagctccagggaaggggctggtgtgggtctcacgtattaatagtgatgggagtagcaaagactacgcggactctgtgaagggccgattcaccatctccagagacaacgccaagaacaccctgtatttgcaaatgaacagtctgagagccgaggacacggctgtgtattactgtgcaagagtggcaggggcgatttatagcagtggctggtataattacaagtacggtatggacgtctggggccaagggaccacggtcaccgtctcctta

SEQ ID NO: 4700 - DNA, 342 bp, Homo sapiens
gacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcattcactgggcatctacccgggaatccggggtccctgaccgattcagtggcagcgggtctgggacagatttcactctcaccatcagcagcctgcaggctgaagatgtggcagtttattactgtcagcaatattatagtactccccggtggacgttcggccaagggaccaaggtggaaatcaaa

SEQ ID NO: 4701 - DNA, 378 bp, Homo sapiens
gaggtgcagctggtggagtctggaggaggcttgatccagcctggggggtccctgagactctcctgtgcagcctctgggttcgccgtcagtagcaactacatgagctgggtccgccaggctccagggaaggggctggagtgggtctcagttatttttggcggcggtagcacatactacgcagactccgtgaagggccgattcaccatctccagagacaattccaagaacacgctgtatcttcaaatgaacagcctgagagccgaggacacggccgtgtattactgtgcgagagagatcgatagtagtggttatgttcccggcctgggctactacggtatggacgtctggggccaagggaccacggtcaccgtctcctca

SEQ ID NO: 4702 - DNA, 324 bp, Homo sapiens
gacatccagatgacccagtctccatcttctgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcactatcagcagcctgcagcctgaagattttgcaacttactattgtcaacaggctaacagtgtccttccgctctctttcggcggagggaccaaggtggagatcaaa

SEQ ID NO: 4703 - DNA, 363 bp, Homo sapiens
caggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagcctctcacggtggctactactacggtatggacgtctggggccaagggaccacggtcaccgtctcctca

SEQ ID NO: 4704 - DNA, 336 bp, Homo sapiens
cagtctgccctgactcagcctgcctccgtgtctgggtctcctggacagtcgatcaccatctcctgcactggaaccagcagtgacattggtggttataactatgtctcctggtaccaacagcacccaggcaaagcccccaaactcatgatttatgaggtcagtaatcggccctcaggggtttctaatcgcttctctggctccaagtctggcaacacggcctccctgaccatctctgggctccaggctgaggacgaggctgattattactgcagctcatatacaagcagcagcacttctctttatgtcttcggaactgggaccaaggtcaccgtccta

SEQ ID NO: 4705 - DNA, 369 bp, Homo sapiens
caggtccagcctgtgcagtctggggctgagatgaagaagcctggggcctcagtgaaggtttcgtgcagggcctctgcatataacttcactaactatggtatccattgggtgcgccaggcccccggacaaaggcttgagtggatgggatggatcaacgctggcaatggtcacacaaaattctcacagaagttccagggcagagtcaccattaccagagacacatccgcgaacactgcctatatggagctgagcagcctgacatctgaagacacggctatgtattactgtgccctgggcgggggcagtggttggtttgggtacaactggttcgacccctggggccagggaaccctggtcaccgtctcctca

SEQ ID NO: 4706 - DNA, 339 bp, Homo sapiens
gacatcgtgatgacccagtctccagactccctggctgtgtctctgggcgggagggccaccatcaactgcaagtccagccagagtgttttatacagctccaacaataagaactacttagcttggtaccagcagaaaccaggagagcctcctaagttgctcatttactgggcatctacccggcaatccggggtccctgaccgattcagtggcagcgggtctgggacagatttcactctcaccatcaccagcctgcaggctgaagatgtggcagtttattactgtcagcaatattatagtacccctctcactttcggcggagggaccaaggtggagatcaaa

SEQ ID NO: 4707 - DNA, 336 bp, Homo sapiens
caggtgcagctgcaggagtcgggcccaggactggtgaagccttcggagaccctgtccctcacctgcactgtctctggtgactccatcagtagttactactggagctggatccggcagcccccagggaagggacttgaatggattggctatatctattacagtgggaccaccaactacagcccctccctcaagagtcgagtcaccatatcagtagacacgtccaagaaccacttctccctgaagctgagctctgtgaccgctgcggacacggccgtgtattactgtgcgagagggtttgacttctggggccagggaaccctggtcaccgtctcctca

SEQ ID NO: 4708 - DNA, 324 bp, Homo sapiens
gaaattgtgttgacgcagtctccaggcaccctgtctttgtctccaggggaaagagccaccctctcctgcagggccagtcagagtgttagtaacatctacttagcctggtaccagcagaaacctggccaggctcccaggctcctcatctatgctacatccagcagggccattggcatcccagacaggttcagtggcagtgggtctgggacagacttcactctcgccatcagcagactggagcctgaagattttgcagtctattactgtcaccactatggtagctcaccgtggacgttcggccaagggaccaaggtggaaatcaaa

SEQ ID NO: 4709 - DNA, 360 bp, Homo sapiens
caggtgcaactggtggagtctgggggaggcgtggaccagcctggcaggtccctgcgactctcgtgcacagcgtctggattcgccgtcagcaactctggcatgcactgggtccgccaggctccgggcaaggggctggaatgggtggcatttttatgggataatggaaggaaagaggactatgtagactccgtgaagggccgattcaccatctccagagacagttccaagaacaccctgtatctgcaaatgaacaacctgagagtcgacgacacggctgtatattactgtgggaaggcactcagtacttcgccgacacctgttgactcctggggtcacggaaccctagtcaccgtctcctca

SEQ ID NO: 4710 - DNA, 324 bp, Homo sapiens
tcctatgtgctgactcagtcaccctcagtgtcactggccccagggaagacggccagcattacctgtggcggtgacaacattggaagtaaaagtgtgcactggtaccagcagaagccaggccaggcccctctattggtcatgttttttgatgacgaccggccctcagcgatccctgagcgattctctggctccaactctgggaacacggcctccctgaccatcagcagggtcgaagccggggatgaggccgactattactgtcaggtgtgggatagcgatcttcgatctgtggttttcggcggagggaccaagctgaccgtccta

SEQ ID NO: 4711 - DNA, 354 bp, Homo sapiens
caggtacacctggtggagtctgggggaggcgtggtccagcctgggaagtccctgagactctcctgtgcagcctcgggattcatcttcagttcctttggcatgcactgggtccgccagcctccaggcaaggggctggagtggctggcagttgtgtcatatgatggaagtgtcacaaaatattcagactcctttgagggccgattcaccatctccagagacaattccaagaataccctgtatctgcaaatggacagcctgagacctgaggacacggctatatattactgtgcaaaaggccaggggacaaatcttcttcattattggggccagggaatcctggtcaccgtctcgtct

SEQ ID NO: 4712 - DNA, 336 bp, Homo sapiens
gatgttgtgctgactcagtctccactctccctgcccgtcacccttggacagccggcctccatctcctgcaggtctagtgaaagcctcgtttacactgatggagacacctacttacattggtttcaccagaggccaggccaatctccaaggcgcctaatttttaaggtttctcatcgggagtctggggtcccagacagaatcagcggcagtgggtcaggcactgatttcacactgaaaatcagcagggtggaggctgaggatgttggggtttattactgcatgcaaggtacacactggccattcactttcggccctgggaccaaagtggatatcaaa

SEQ ID NO: 4713 - DNA, 366 bp, Homo sapiens
caggtgcagctggtgcagtctggggctgaggtgaagaagcctgggtcctcggtgaaggtctcctgcaaggcttctggaggcaccttcagcaactatcctatcaactgggtgcgacaggcccctggacaagggcttgagtggatgggaaggatcatccctatccttgatataacaaactacacacagaaattccagggcagagtcacgattatcgcggacaaatccacgagcacagcctacatggagctgagcagcctcagatctgaggacacggccgtgtattactgtgcgagagatcccgggggaatacgttttacggtacactttgactactggggccagggaaccctggtcaccgtctcctca

SEQ ID NO: 4714 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagagacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcattatggtagctcacccgtcaccttcggccaagggacacgactggagattaaa

SEQ ID NO: 4715 - DNA, 372 bp, Homo sapiens
caggtgcagctgcaagagtcgggcccaggactggtgaagccttcacagaccctgtccctcacctgcactgtctctggtgactccatcggcagtggtggttactactggagctggctccgccagctcccagggaagggcctggagtggattggatacatctattacagagggaacacctactacaacccgtccctcaagagtcgagttaccatatctctagacacgtctaagaaccagttctccctgaggctgacctctgtgactgccgcggacacggccgtatattactgtgcgagtttttctgaagagcagctgataccgacgggctactttgacaactggggccggggaatcctggtcaccgtctcctca

SEQ ID NO: 4716 - DNA, 324 bp, Homo sapiens
gaaatagtgatgacgcagtctccagccaccctgtctgtgtctccaggggaaagagccaccctctcctgcagggccagtcagagtgttcgcagcaacttagcctggtaccagcagaaacctggccaggctcccaggctcctcatctatgacacatccatcagggccactggtatcccagccaggttcagtggcagtgggtctgggacagagttcactctcaccatcagcagcctgcagtctgaagattttgcagtttattactgtcagcagtataattcctggcctccatacacttttggccaggggaccaagctggagatcaaa

SEQ ID NO: 4717 - DNA, 363 bp, Homo sapiens
caggtgcagctggtggagtctgggggaggcgtggtccagcctgggaggtccctgagactctcctgtgcagcctctggattcaccttcaatagctatgctatctactgggtccgccaggctccaggcaaggggctggagtgggtggcagttatatcatatgatggattcaatgagtactacgcagactccgtgaagggccgattcaccatctccagagacaattctaagaacacgctctatctacaaatgaacagcctgagaactgaggacacggctgtgtattactgtgcgagaccccatagtgggagctacttctccttctttgactactggggccagggaaccctggtcaccgtctcctca

SEQ ID NO: 4718 - DNA, 321 bp, Homo sapiens
gaatttgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccgctggcatcccagacaggttcagtggcagtgggtctgggacagacttcactctcaccatcagcagactggagcctgaagattttgcagtgtattactgtcagcagtatggtagctcacccctttttggccaggggaccaagctggagatcaaa

SEQ ID NO: 4719 - DNA, 366 bp, Homo sapiens
gaggtgcagctggtggagtctgggggaggcttggtacagcctggggggtccctgagactctcctgtgcagcctctggattcaccttcagtaactacgacatgcactgggtccgccaagctacaggaaaaggtctggagtgggtctcacttattggtactgctggtgacacatactatccaggctccgtgaagggccgattcaccatctccagagaaaatgccaagaactccttgtatcttcaaatgaacagcctgagagccggggacacggctgtgtattactgtgcaagaggctactatgatagtagtggtttttactcctactttgactactggggccagggaaccctggtcaccgtctcctca

SEQ ID NO: 4720 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagatttcgcaacttactactgtcaacagagttacagtatgcccccgtacacttttggccaggggaccaagctggagatcaaa

SEQ ID NO: 4721 - DNA, 351 bp, Homo sapiens
gaggtacagttggtggagtctggaggaggcttgatccagcctggggggtccctgagactctcctgtgcagtctctggcttcaccgtcagtagcaactacatgagctgggtccgccaggctccagggaaggggctggagtgggtctcagttgtttatagcggtggtagcacatactacgcagactccgtgaggggccgattcaccatctccagagacaattccaagaacacactgtatcttcaaatgaacagcctcagagccgaagacacggccgtttactactgtgcgagagaccatgtgttatctggtatggacgtctggggccaagggaccacggtcaccgtctcctca

SEQ ID NO: 4722 - DNA, 321 bp, Homo sapiens
gacatccagatgacccagtctccatcctccctgtctgcatctgtaggagacagagtcaccatcacttgccaggcgagtcaggacattaacaaatatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaccagtatgataatctccctcggacgttcggccaagggaccaaggtggaaatcaaa

SEQ ID NO: 4723 - DNA, 363 bp, Homo sapiens
caggtgcagctggtggagtctgggggaggcgtggtccagcctgggaggtccctgagactctcctgtgcagcctctggattcaccttcagtggttatgctatgtactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacagggctgtgtattactgtgcgagagctactgggggttcctactactacggtatggacgtctggggccaagggaccacggtcaccgtctcctca

SEQ ID NO: 4724 - DNA, 324 bp, Homo sapiens
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcactgtggacgttcggccaagggaccaaggtggaaatcaaa

SEQ ID NO: 4725 - DNA, 387 bp, Homo sapiens
gaggtgcagctggtggagtccgggggaggcttagttcagcctggggggtccctgagactctcctgtgcagcctctggattcaccttcagtagcttctggatgcactgggtccgccaagctccagggaaggggctggtgtgggtctcacgtattcataatgatgggactagtacattctatgcggactccgtgaagggccgattcaccatctccagagacaacgccaagaacacactgtatctgcaaatgaacagtctgagagccgaggacacggctgtgtatttctgtgcaagagataggtcggtctctcagtatagcagtgggtggtaccactactactacgctatggacgtctggggccaagggaccacggtcaccgtctcctca

SEQ ID NO: 4726 - DNA, 330 bp, Homo sapiens
gaacttgtgttgacgcagtctccaggcaccctgtccttgtctccaggggaaagagccaccctctcctgcagggccagtcagagtgtcagcagcagctactcagcctggtaccagcagaaacctggccaggctcccaggctcctcatctatggtgcaaccagcagggccactggcatcccagacaggttcagtggcagtgggtctgggacagacttcactctcaccatcaacagactggagcctgaagattttgcagtgtattactgtcagcagtatggtggctcacctccggagttcactttcggccctgggaccaaagtggatatcaaa

SEQ ID NO: 4727 - DNA, 378 bp, Homo sapiens
gaggtgcagctggtgcagtctggagcagaggtgaaaaagcccggggagtctctgaagatctcctgtaagggttctggatataagtttaccagttattggatcgcctgggtgcgccagatgcccgggaaaggcctggagtggatgggggtcatctatcctgatgactctgataccagatacagcccgtccttccaaggccaggtcaccatctcagccgacaagtccatcaacaccgcctccctgcagtggagcagcctgaaggcctcggacaccgccatgtattactgtgcgagggtcacctattattatgtttcggggagttattataacggcggtatggacgtctggggccaagggaccacggtcaccgtctcctca

SEQ ID NO: 4728 - DNA, 327 bp, Homo sapiens
gaaattgtgttgacgcagtcgccaggcaccctgtccttgtctccaggggaaagagccaccctctcctgcagggccagtcagagtgttagcagcagctacttagcctggtaccagcagaaacctggccaggctcccaggctcctcatctatggtgcatccagaagggccactggcatcccagacaggttcagtggcagtgggtctgggacagacttcactctcaccatcagcagactggagcctgaagattttgcagtgtatcactgtcagcagtctggtagttcacttacgtggacgttcggccaagggaccaaggtggaaatcaaa

SEQ ID NO: 4729 - DNA, 372 bp, Homo sapiens
caggtgcagttggtggagtctgggggaggcgtggtccaccctgggaggtccctgagactctcctgtgcagcctctggattcatttttagtacccgtgctatgcactgggtccgccaggctccaggcaaggggctggagtgggtggcagttatatcatatgatggaactaataaatactacagagactccgtgaagggccgattcaccatctccagagacaattccaagaacactctgtatctgcaaatgaacagcctgagacctgaggacgcggctctatattactgtgtgagagatggcgactcgggctggttattggttggtaactggttcgacgtctggggccagggaaccctggtcaccgtctcctca

SEQ ID NO: 4730 - DNA, 333 bp, Homo sapiens
cagtctgccctgactcagcctgcctccgtgtctgggtctcctggacagtcgatcaccatctcctgcactggaaccagcagtgacgttggtggttttaactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcatcactctatatgtcttcggaactgggaccaaggtcatcgtccta

SEQ ID NO: 4731 - DNA, 378 bp, Homo sapiens
gaggtgcagctggtggagtctgggggaggcttggtacagcctggggggtccctgagactctcctgtgcagcctctggattcatcttcagtagctataacatgaactgggtccgccaggctccagggaaggggctggagtggatttcatacattagtaggagtagtagtaccatatactacgcagactctgtgaagggccgattcaccatctccagagacaatgccaagaactcactgtatctgcaaatgaacagcctgagagacgaggacacggctatgtattactgtgcgagagactcttacgatattttgactggttataattcaatacctccctttgactactggggccagggaaccctggtcaccgtctcctca

SEQ ID NO: 4732 - DNA, 321 bp, Homo sapiens
gacatccagatgacccagtctccatcctccctgtctgcatctgtaggagacagagtcaccatcacttgccgggcaagtcagggcattagaaatgatttgggctggtatcagcagaaaccagggaaagcccctcagcgcctgatctatgctgcatccagtttgcaaactggggtcccatcaaggttcagcggcagtggatctgggacagagttcactctcacaatcagcagcctgcagcctgaagattttgcaacttattactgtctacagtataatagttaccctatcaccttcggccaagggacacgactggagattaaa

SEQ ID NO: 4733 - DNA, 387 bp, Homo sapiens
caggtccagctggtgcagtctggggatgaggtgaagaagcctgggtcctcggtgaaggtctcctgcaaggcttctggaggcaccttcagcagctatgctatcagttgggtgcgacaggcccctggacaagggcttgagtggatgggaaggatcatccctatccttgggacagcaaattacgcacagaggttccagggcagagtcacgattaccgcggacaaatccacgagcacagcctacatggagctgagcagcctgagatctgaggacacggccgtttattactgtgcgagggggggattgtatttctatgatagtagtacttattcctcggaccattactactttgactcttggggccagggaaccccggtcaccgtcgcctca

SEQ ID NO: 4734 - DNA, 333 bp, Homo sapiens
aattttatgctgactcagccccactctgtgtcggagtctccggggaagacggtaaccatctcctgcaccggcagcagtggcagcattgccagcaactatgtgcagtggtaccagcagcgcccgggcagtgcccccaccactttgatctatgaggataaccaaagaccctctggggtccctgatcggttctctggctccatcgacagctcctccaactctgcctccctcaccatctctggactgaagactgaggacgaggctgactactactgtcagtcttatgatagcagcaaccatgtgctattcggcggagggaccaagctgaccgtccta

SEQ ID NO: 4735 - DNA, 357 bp, Homo sapiens
gaggtgcagttggtggagtctgggggaggcttggtccagcctggggggtccctgggactctcctgtggagcctctagattcacctttagtagctattggatgagttgggtccgccaggctccagggaaggggctggagtgggtggccaacataaaacaagatggaggtgagaaatattatgtggactctgtgaagggccgattcaccatctccagagacaacgccaagaactcactttatctgcaaatgaacagcctgagagccgaggacacggctgtgtattactgtgtgagactaggtagcagtagctggtactttgaatactggggccagggaaccctggtcaccgtctcctca

SEQ ID NO: 4736 - DNA, 318 bp, Homo sapiens
tcctatgaactgactcagccaccctcagtgtccgtgtccccaggacagacagccagcatcacctgctctggagataatttgggggataaatatgtttgctggtatcagcagaagccaggccagtcccctgtggtggtcatctatcaagataacaagcggccctcagggatccctgagcgattctctggctccaactctgggaacacagccactctgaccatcagggggacccaggctatggatgaggctgactattactgtcaggcgtgggccagcagcactgctgtcttcggaactgggaccaaggtcaccgtccta

SEQ ID NO: 4737 - DNA, 357 bp, Homo sapiens
gaggtgcagctggtggagtctgggggaggcctggtccagcctggggggtccctgagactctcctgtgcagcctctgggttcacctttagtgactattggatgagctgggtccgccaggctccagggaaggggctggagtgggtggccaacataaagcaagacggaagtgagaaatactatgtggactctgtgaagggacgattcaccatctccagagacaacgccaagaactcactgaatctgcaaatgaatagtctgagagccgaggacacggctgtatattactgtgcgagagagaataatggtgaccccctatttgtctactggggccagggaaccctggtcagcgtctcctca

SEQ ID NO: 4738 - DNA, 321 bp, Homo sapiens
gacatccagatgacccagtctccatcctccctgtctgcatctataggagacagagtcaccatcacttgtcgggcgagtcacgatattagcagctggttagcctggtatcagcagaagccagagaaagcccctaagtccctgatctatgctgcatccagtttgcaaagtggggtcccatcaaggttcggcggcagtggatctgggacaaatttcactctcaccatcagcaggctacagcctgaagattttgtaacttattactgccaacagtataatagatacccgtacacttttggccaggggaccaagctggagatcaaa

SEQ ID NO: 4739 - DNA, 372 bp, Homo sapiens; identical to SEQ ID NO: 4299

SEQ ID NO: 4740 - DNA, 321 bp, Homo sapiens
gacatccagatgacccagtctccttccaccctgtctgcatctgtaggagacagagtcaccatcacttgccgggccagtcagagtattagttcctggttggcctggtatcagcagaaaccagggaaagcccctaaactcctgatctataaggcgtctagtttagaaaatggggtcccatcaaggttcagcggcagtggatctgggacagaattcactctcaccatcagcagcctgcagcctgatgattttgcaacttattactgccaacagtataatagttattctcggacgttcggcctagggaccaaggtggaaatgaaa

SEQ ID NO: 4741 - DNA, 342 bp, Homo sapiens
caggtgcagctacagcagtggggcgcaggactggtgaagccttcagagaccctgtccctcacctgcgctgtctctggtgagtccctctgtggttactactggagctggatccgccagcccccagggaaggggctggagtggattggtgacatcacctgtagtggaagcaccacctacaatgagcccttcaagagtcgagtcaccatatcagttgacacgtccaagaaccaattctccctgaacctgacctctatgactgccgcggacacggctgtctattactgttcgagaggccgacagcagctgaagtggggccagggaaccctggtcaccgtctcccca

SEQ ID NO: 4742 - DNA, 336 bp, Homo sapiens
gatattgtgatgactcagtctccactctccctgcccgtcacccctggagagccggcctccatctcctgcaggtctagtcagagcctcctgcatagaaatggatacaaatatttggattggtatctgcagaagccagggcagtctccacagctcctaatctatttgggctctaatcgggcctccggggtccctgacaggttcagtggcagtgggtcaggcacagattttacactgaaaatcagcagagtggaggctgacgatgttggggtttattactgcatgcaaactctacaaattccggccactttcggccctgggaccaaagtggagatcaaa

SEQ ID NO: 4743 - DNA, 360 bp, Homo sapiens
caggtacagctggtggagtctgggggaggcgtggtccagcctgggaggtccctgagactctcctgtgcagcctctggattcaccttcagtagatttactctacactgggtccgccaggctccaggcaaggggctggagtgggtggcagttatatcatatgatggaagcaataaatattacgcagactccgtgaagggccgattcaccatctccagagacaattccaagagcactctctatctgcaaatgaacagcctgagagctgaggacacgggtgtgtattactgtgcgagagatccctctacggtgaccggctactttgactactggggccagggaaccctggtcaccgtctcctca

SEQ ID NO: 4744 - DNA, 315 bp, Homo sapiens
tcctatgtgctgactcagccaccctcagtgtcagtggccccaggaaagacggccaagatttcctgtgggggagacagcattggaagtaaaagtgtccactggtaccagcagaagccaggccaggcccctgtgctggtcatctattatgataacgaccggccctcagggatccctgagcgattctctggctccaactctgggaacacggccaccctgaccatcagcagggtcgaagccggggatgaggccgactattactgtcaggtgtgggatattggtgtggtattcggcggagggaccaagctgaccgtccta

SEQ ID NO: 4745 - DNA, 390 bp, Homo sapiens
caggtacaactgcagcagtcaggtccaggactggtgaagccctcgcagaccctctcactcacctgtgccatcttcggggacagtgtctctagcaacagtgccgcttggaactggatcaggcagtccccatcgagaggccttgagtggctgggaaggacatactacaggtccaagtggtataatcactatgaactgtctgtgaaaagtcgaatgaccatcaacccagacacatccaagaaccagttctccctgcatctgaactctgtgactcccgaggacacggctgtgtattactgtgcaagatcccgaagtatatcttgtagtggtgattgctatcctggtgcctcttttgatatctggggccaagggacaatggtcaccgtctcttca

SEQ ID NO: 4746 - DNA, 330 bp, Homo sapiens
cagtctgtgctgactcagccaccctcagcatctgcgacccccgggcagagggtcaccatctcttgttctggaagcagctccagcatcggaagtaattatgtatattggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcaacatgggatgacagcctgagtggtccggtattcggcggagggaccaagatgaccgtccta

SEQ ID NO: 4747 - DNA, 369 bp, Homo sapiens
caagtgcagctgcaggagtcgggcccaggactggtgaagccttcggagaccctgtccctcacctgcactgtctctggtggctccatcagtacttactactggacctggatccggcagcccccagggaagggactggagtggattggctatatctattacagtgggagcgccaactacaacccctccctcaagagtcgagtcaccatatcagtagacacgtccaagaaccagttctccctgaagctgaactctgtgaccgctgcggactcggccgtgtatttctgtgcgagagagaggttcagtctgttagatggctacaacggggcttttgactactggggccggggaaccctggtcaccgtctcctca

SEQ ID NO: 4748 - DNA, 339 bp, Homo sapiens
gacatcgtgatgacccagtctccagactccctggctgtgtctctgggcgagagggccaccatcaactgcaagtccagccagagtgttttatacagctccaacaataagaactacttagcatggtaccagcagaaaccaggacagcctcctaagatgctcattcactgggcacttacccgggaatccggggtccctgaccgattcagtggcagcgggtctgggacagatttcactctcaccatcagcagcctgcaggctgaagatgtggcagtttattactgtcagcaatattataatgctcctcggacgttcggccaagggaccaaggtggaaatcaaa

SEQ ID NO: 4749 - protein, 123 aa, Homo sapiens
EVHLLESGGGLVRPGGSLRLSCAASEFTFGNYAMTWVRQAPGKGLEWVSVIFGSGTGTYYGDSVKGRFTVSRDNSKNTLYLQMNSLRADDTAVYYCAKLAGVQHLIYWYFDLWGRGTLVTVSS

SEQ ID NO: 4750 - protein, 109 aa, Homo sapiens
EIVLTQSPATLSLSPGERATLSCRASQSVGSSLAWYQQKAGQAPRLLIYDAFNRAIGIPARFSGSGSGTDFTLTISSLEPEDFAVYYCQQRDNWPPEVTFGGGTKVEIK

SEQ ID NO: 4751 - protein, 125 aa, Homo sapiens
QLQLQESGPGLVKPSETLSLTCSVSGASISSVSYYWGWIRQPPGKGLEWIGAIYYTGNTYYNSSLKSRVTISVDTSKNHFSLKLTSVTAADTAVYYCARVDRAISRYSLNWFDPWGQGTLVTVSS

SEQ ID NO: 4752 - protein, 109 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPLYTFGQGTKLEIK

SEQ ID NO: 4753 - protein, 121 aa, Homo sapiens
EVQLVESGGGLIQPGGSLRLSCAASGLTVSSNYMSWVRQAPGKGLEWVSVIYSGGSTYYADSVKGRFTISRDNSKNTLYLQMNSLRAEDTGVYYCARGDGYDSFYYGFDVWGQGTTVTVSS

SEQ ID NO: 4754 - protein, 111 aa, Homo sapiens
QSVLTQPPSVSGAPGQRVTISCTGSSSNIGAGYDIHWYQQLPGTAPKLLIYGNSNRPSGVPDRFSGSKSGTSASLAITGLQAEDEADYYCQSYDSSLSGSVFGGGTKLTVL

SEQ ID NO: 4755 - protein, 128 aa, Homo sapiens
QVQLVQSGAEVKKPGASVKVSCKVSGYTLIELSMHWVRQAPGKGLEWMGGFDPEDGETIYAQKFQGRVTMTEDTSTDTAYMELSSLRSEDTAVYYCATAPTQDYYDSSGYYRGWFDPWGQGTLVTVSS

SEQ ID NO: 4756 - protein, 110 aa, Homo sapiens
QSALTQPASVSGSPGQSITISCTGTSSDVGGYNYVSWYQQHPGKAPKLLIYDVSNRPSGVSNRFSGSKSGNTASLTISGLQAEDEADYYCSSYTSSSSYVFGTGTKVTVL

SEQ ID NO: 4757 - protein, 121 aa, Homo sapiens
EVQLVESGGGLIQPGGSLRLSCAASGFTVNDHYMYWVRQAPGKGLEWVSIIYSGGSTYYADSVKGRFTISRDNSKNTLYLQMNGLRAEDTAVYYCARDPYCSGISCSGDYWGQGTLVTVSS

SEQ ID NO: 4758 - protein, 107 aa, Homo sapiens
DIQMTQSPSSLSASVGDRVTITCQASQDISNYLNWYHQKPGKAPKLLIYDASNLKTGVPSRFSGSGSGTDFTFTISSLQPEDIATYYCQQNHHPPYTFGQGTKLEIR

SEQ ID NO: 4759 - protein, 121 aa, Homo sapiens
QVQLVESGGGVVQPGRSLRLSCAASGFTFSTHAMHWVRQAPGKGLEWVALISYDGNNKYYTDSVKGRFTISRDNSKNTLYLQMNSLRAEDTAVYYCARGTGGGYYYGMDVWGQGTAVTVSS

SEQ ID NO: 4760 - protein, 107 aa, Homo sapiens
DIQMTQSPSSLSASVGDRVTITCRASQTISSYLNWYQQKPGKAPKLLIYAASSLQSGVPSRFSGSGSGTGFTLTISSLQPEDCAIYYCQQSYSSPQTFGQGTKVEIK

SEQ ID NO: 4761 - protein, 118 aa, Homo sapiens
EVQLVESGGGLVKPGGSLRLSCAASGFTFSNAWMSWVRQAPGKGLEWVGHIESKTDGGTTDYAAPVKGRFTISRDDSKNTLYLQMNSLKTEDTALYYCTRGPFYFDFWGQGTLVTVSS

SEQ ID NO: 4762 - protein, 107 aa, Homo sapiens
DIQMTQSPSTLSASAGDRVTIACRASQSISSWLAWYQQKPGQAPKLLIYKASSLKSGVPSRFSGSGSGTEFTLTISSLQPGDFATYYCQQYNNYPWTFGQGTKVAIK

SEQ ID NO: 4763 - protein, 125 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARAVYSVYDQLLNGMDVWGQGTTVTVSS

SEQ ID NO: 4764 - protein, 107 aa, Homo sapiens
DIQLTQSPSFLSASVGDRVTITCRASEDISSYLAWYQHKPGKAPKLLIYAASALQSGVPSRFSGSGSGTEFTLTISSLQPEDFAAYYCQQLHSYPLTFGPGTKVDIK

SEQ ID NO: 4765 - protein, 121 aa, Homo sapiens
QVQLVQSGAEVQKPGASVRVSCKASGFTFTNNPIHWVRQAPGQRLEWMGWITAGTDYTKYSQNFQGRVTFTSDTSASTVYMDLNNLKSDDTAVYYCVRGGRAGNNPPFDHWGRGTLVTVSS

SEQ ID NO: 4766 - protein, 108 aa, Homo sapiens
EIVLTQSPGTLSLSPGERVTLSCRASQSVSNNALAWFQQRPGQAPRLLIYGASNRATGIPDRFSGSASGTDFTLTISRLEPEDFAVYYCQQYGSSPFTFGGGAKVEIK

SEQ ID NO: 4767 - protein, 125 aa, Homo sapiens
QLQLQESGPGLVRPSETLSLTCTVSGGSISSSSYYSGWIRQPPGKGLEWIGNIYYGGSTYYNPSLKSRVTISVDTSKNQFSLKLSSVTAADTAVYYCATEAITMMVLAHHAFDIWGQGTTVTVSS

SEQ ID NO: 4768 - protein, 110 aa, Homo sapiens
QSALTQPASVSGSPGQSITISCTGTSSDVGGYNYVSWYQQHPGKVPKLMIYEVSNRPSGVSNRFSGSKSGNTASLTISGLQTEDEADYYCSSYTSISTYVFGTGTKVTVL

SEQ ID NO: 4769 - protein, 121 aa, Homo sapiens
QVQLVESGGGVVQPGRSLRLSCAASGFTFSTYALYWVRQAPGKGLEWVAVISYDGNNKYYADSVRGRFAVSRDNSKNTLYLQMNSLRTEDTAVYYCARPLSGSYLSYFDYWGQGTLVTVSS

SEQ ID NO: 4770 - protein, 111 aa, Homo sapiens
QSVLTQPPSVSGAPGQRVTISCTGSSSNIGAGYDVHWYQQLPGTAPKLLIYGNTNRPSGVTDRFSGSKSGTSASLAITGLQAEDEADYYCQSYDSNLSGPVFGGGTKLTVL

SEQ ID NO: 4771 - protein, 127 aa, Homo sapiens
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGSGAAAETPHYYYYYGMDVWGQGTTVTVSS

SEQ ID NO: 4772 - protein, 108 aa, Homo sapiens; identical to SEQ ID NO: 758

SEQ ID NO: 4773 - protein, 126 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTASDTAVYYCASTNPPSLWFGESHAFDIWGQGTMVTVSS

SEQ ID NO: 4774 - protein, 110 aa, Homo sapiens; identical to SEQ ID NO: 3030

SEQ ID NO: 4775 - protein, 112 aa, Homo sapiens
QVQLQESGPGLVKPSETLSLTCTVSGDSISSYYWSWFRQPPGKGLEWIGYIYYSGRTNYNPSLQSRVTISVDTSKNQFSLKLSSVTAADTAVYYCARDFSSWGQGTLVIVSS

SEQ ID NO: 4776 - protein, 108 aa, Homo sapiens
EIVLTQSPGTLSLSPGERATLSCRASQSVSNIYLAWYQQKPGQAPRLLIYGASSRAIGIPDRFSGSGSGTDFTLTISRLEPEDFAVYYCQQYGSSPWTFGQGTKVEIK

SEQ ID NO: 4777 - protein, 119 aa, Homo sapiens
EVQLVESGGGLIQPGGSLRLSCAASGVTVRSNYMSWVRQAPGKGLEWVSVIYSGGSTFYADSVKGRFTISRDNSKNTLYLQMNSLRGEDTAVYYCVRAEAWGSGAFDPWGQGTLVTVSS

SEQ ID NO: 4778 - protein, 103 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQHLNFFGGGTKLEIK

SEQ ID NO: 4779 - protein, 131 aa, Homo sapiens
QVQLMESGGGVVQPGRSLRLSCAASGFTFNTYAMHWVRQAPGKGLEWVAVISNDGSDIYYADSVKGRFTISRDNSKNTLYLQMNSLRAEDTAVYYCARDRQYYDTLTDYYVPTSEYHFDYWGQGTLVTVSS

SEQ ID NO: 4780 - protein, 107 aa, Homo sapiens
DIQMTQSPSSVSAVVGDRVTITCRASQGISSWLAWYQQKPGTAPKLLIYAASNLQSGVPSRFSGSGSGTDFTLTITSLQPEDFATYYCQQAHSFPPTFGGGTKVEIK

SEQ ID NO: 4781 - protein, 128 aa, Homo sapiens
EVHLLQSGAEVKKPGTTVKISCKVSGYIFTDYYIHWIQQAPGKGLEWVGLIDPEDDQTIYADKFKGRVVISADTSTDTAFMELSSLTSDDTAVYYCVSLISGVVTRAQGGQGQNFDYWGQGTLVSVSS

SEQ ID NO: 4782 - protein, 109 aa, Homo sapiens
DFKMTQSPSTLSASVGDRVTITCRASQSIDNWLAWYQQKPGKAPKVLIHMASSLQSGVPSRFSGSGSGTEFTLTISRLQPDDFATYYCLQYTVGWGGWTFGAGTKVEIK

SEQ ID NO: 4783 - protein, 123 aa, Homo sapiens
EVQLLESGGGLVQPGGSLRLSCVASEFRFSDYAMTWVRQAPGKGLEWVSAIFGSGSGRYYGDSVKGRFTVSRDNSKNTLYLQMNSLRADDTAVYYCAKLGGAQHLIYWHFDLWGRGTPVTVSS

SEQ ID NO: 4784 - protein, 109 aa, Homo sapiens
EIVLTQSPVTLSLSPGERATLSCRASQSIGTSLAWYQHRAGQAPRLLIYDAFNRAIGIPARFSGSGSGTDFTLTISSLEPEDFAVYYCQQRDNWPPEVTFGGGTKVEIK

SEQ ID NO: 4785 - protein, 123 aa, Homo sapiens
QLQLQESGPGLVKPSETLSLTCTVSGGSISSSNYYWGWIRQPPGKGLEWIGSIYYSGSTYYNPSLKSRVTISVDTSKNQFSLKLSSVTAADTAVYYCARDQATATDLDGMDVWGQGTTVTVSS

SEQ ID NO: 4786 - protein, 108 aa, Homo sapiens; identical to SEQ ID NO: 758

SEQ ID NO: 4787 - protein, 115 aa, Homo sapiens
QVQLVQSGAEVKKPGASMKVSCKASGYTFTGYYMYWVRQAPGQGLEWMGWINPNSGGTNYAQKFQGRVTMTRDTSISTAYMELSRLRSDDTAVYYCARERFLDYWGQGTLVTVSS

SEQ ID NO: 4788 - protein, 107 aa, Homo sapiens
DIQMTQSPSSLSASVGDRVTITCRASQSISSYLNWYQQKPGKAPNLLMYAASSLQSGVPSRFSGSGSGTDFTLTISSLQPEDFATYYCQQSYSTPYTFGQGTKLEIK

SEQ ID NO: 4789 - protein, 126 aa, Homo sapiens
QVQLVQSGAEVKKPGASVKVSCKASGYTFTSNYMHWVRQAPGQGLEWMGIINPSGGSTSYAQKFQGRVTMTRDTSTSTVYMELSSLRSEDTAVYYCARDLTTVTTIYDYYYGMDVWGQGTTVTVSS

SEQ ID NO: 4790 - protein, 108 aa, Homo sapiens
SYELTQPPSVSVSPGQTARITCSGDALPKQYAYWYQQKPGQAPVVVTYKDSERPSGIPERFSGSSSGTTVTLTISGVQAEDEADYYCQSADSSGSYVVFGGGTKLTVL

SEQ ID NO: 4791 - protein, 128 aa, Homo sapiens
QVQLVQSGAEVKKPGASVKVSCKVSEYTLTELSIHWVRQAPGKGLEWMGGFDPEEGETIYAQKFQGRVTMTEDTSTDTAYMELSSLRSEDTAVYYCATSGWYNCSSTICYGAKWFDPWGQGTLVTVSS

SEQ ID NO: 4792 - protein, 110 aa, Homo sapiens
QSVLTQPPSVSAAPGQQVTISCSGSSSNIGNNYVSWYQQLPGTAPKLLIYDNNKRPSGIPDRFSGSKSGTSATLGITGLQTGDEADYYCGTWDSSLSAVIFGTGTKVTVL

SEQ ID NO: 4793 - protein, 112 aa, Homo sapiens
QVQLQESGPGLVKPSETLSLTCTVSGDSISGYYWSWIRQPPGKGLEWIGYIYYSGRTDYNPSLKSRVTISGDTSKNQLSLKLNSVTAADTAVYYCARGFDSWGQGTLVTVSS

SEQ ID NO: 4794 - protein, 108 aa, Homo sapiens
EIVLTQSPGTLSLSPGERATLSCRASQSVSSIYLAWYQQKPGQAPRLLIFGASSRATGIPDRFSGSGSGTDFTLTISRLEPEDFAVYFCQQYGSSPWTFGQGTKVEIK

SEQ ID NO: 4795 - protein, 121 aa, Homo sapiens
QITLKESGPTLVKPTQTLTLTCTFSGFSLSTSGVGVGWIRQPPGKALEWLALLYWSDDKRYSPSLKTRLTITQDTSKNQVVLTMTNVDPVDTATYFCAQVVVITGDAFDIWGQGTMVTVSS

SEQ ID NO: 4796 - protein, 107 aa, Homo sapiens
SYELTQPPSVSVSPGQTARITCSGDTLPKQYVYWYQQKPGQAPVLVIYKDSERPSGIPERFSGSSSGTKVTLTIIGVQAEDEADYYCQSADSSGTYVFGAGTKVTVL

SEQ ID NO: 4797 - protein, 130 aa, Homo sapiens
QVQLVQSGAEVKKPGSSVKVSCKASGGTFSTYAISWVRQAPGQGPEWMGRIIPMYDRAHIAQKFQGRVTITADISTSTAYMELSSLRSEDTAVYYCARVTGYCSTTSCYGGYHYNGMDVWGQGTTVTVSS

SEQ ID NO: 4798 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 4799 - protein, 125 aa, Homo sapiens
EVQLVESGGGLVQPGGSLRLSCAASGFTLSSYWMTWVRQAPGTGLEWVANINQDGSEEYYVDSVRGRFTISRDNAKNSLYLQMNSLRAEDTAVYYCARENCGGDCYSPSFGMDVWGQGTTVTVSS

SEQ ID NO: 4800 - protein, 107 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQSNTYPITFGGGTKVEIK

SEQ ID NO: 4801 - protein, 130 aa, Homo sapiens
QVLLVQSGAEVKKPGASVKVSCKASGYTFTGHYIHWVRQAPGQGLEWMGWINPISGGTNYAQKFQGRVTMTRDTSISTAYMELSRLRSDDTAVYYCAREGLFSGGGARGLTDYYYGLDVWGQGTTVTVTS

SEQ ID NO: 4802 - protein, 115 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYHSTPPIFTFGPGTKVDIK

SEQ ID NO: 4803 - protein, 117 aa, Homo sapiens
EVQLVESGGGLVQPGGSLRLSCAASGLTVSSNYMSWVRQAPGKGLEWVSIIYSGGSTFYVDSVKGRFTISRDNSKNTLDLQMNSLRAEDTAVYYCARDLSEYGMDVWGQGTTVTVSS

SEQ ID NO: 4804 - protein, 110 aa, Homo sapiens
QSALTQPPSVSGSPGQSVTISCTGTSSDVGSYNRVSWYQQPPGTAPKLMIYEVSNRPSGVPDRFSGSKSGNTASLTISGLQAEDEADYYCSSYTSSSTLVFGGGTKLTVL

SEQ ID NO: 4805 - protein, 125 aa, Homo sapiens
QLQLQESGPGLVKPSETLSLTCTVSGGSISSSSYYWGWVRQPPTKGLEWIGSIYYSGSTYYNPSLKSRVTISVDTSRNQFSLRLSSVTAADTAVYYCATSMVRLDYYNYYGMDVWGQGTTVTVSS

SEQ ID NO: 4806 - protein, 110 aa, Homo sapiens
QSALTQVASVSGSPGQSITFSCTGTSSDVGGYNYVSWYQQHPGKAPKLMIYDVTNRPSGVSDRFSGSKSGNTASLTISGLQPEDEANYYCSSYTTISTWVFGGGTKLTVL

SEQ ID NO: 4807 - protein, 117 aa, Homo sapiens; identical to SEQ ID NO: 4803

SEQ ID NO: 4808 - protein, 107 aa, Homo sapiens
DIQMTQSPSSVSASVGDRVTITCRASQGISSWLAWYQQKPGKAPKLLIYAASSLQSGVPSRFSASGSGTDFTLTISNLQPEDFATYFCQQTNSFPPHFGQGTRLEIK

SEQ ID NO: 4809 - protein, 123 aa, Homo sapiens
EVQLVESGGGLVEPGGSLRLSCAASGFIFSRDWMHWVRQAPGKGLVWVSRIDSDGSSTSYADSVKGRFTISRDNAKNTLYLQMNNLRAEDTAVYYCARVEARWLGGYLPFDSWGQGTLVTVSS

SEQ ID NO: 4810 - protein, 113 aa, Homo sapiens
DIVMTQSPDSLAVSLGERATIDCKSSQSVLYYSNKKNYLAWYQQKPGQPPKLLIYWASTRESGVPDRFSGSGSGTHFTLTISSLQAEDVAVYYCQQYYSTPLTFGGGTKVEIK

SEQ ID NO: 4811 - protein, 121 aa, Homo sapiens
EVQLVESGGGLVKPGGSLRLSCAASGFAFTNYHMNWVRQAPGKGLEWVSSISRFSSDTFYADSVRGRFTISRDNAKNSLHLQLDSLRAEDTAIYYCARDRRAVAGTPFDYWGRGTLVAVSS

SEQ ID NO: 4812 - protein, 109 aa, Homo sapiens
SYVLTQPPSVSVAPGKTATITCGELKVGTQGVHWYQQKPGQAPVLIIYYDNDRPSDIPERFSGSNSGNTATLTINRVEAGDEADYFCHAWDISGDLRHVFGTGTKVTVL

SEQ ID NO: 4813 - protein, 125 aa, Homo sapiens
QLQLQESGPGLVKPSETLSLTCTVSGGSISSSSYYWGWIRQPPGKGLEWIGNIYYSGTTYYNPSLRSRVTISVDTSKNQFSLKLSSVTAADTAVYFCATETTVTTRYYYYAMDVWGQGTTVTVPS

SEQ ID NO: 4814 - protein, 110 aa, Homo sapiens
QSALTQPASVSGSPGQSITISCTGTSSDVGGYNYVSWYQQHPGKAPKVIIYEVSNRPSGVSNRFSASTSGNTASLTISGLQAEDEADYYCSSFTSISTLVFGTGTKVTVV

SEQ ID NO: 4815 - protein, 120 aa, Homo sapiens
QVQLVESGGGVVQPGRSLRLSCAASGFTFSGYAMHWVRQAPGKGLQWVAVISYDGINKYYPDSVKGRFTISRDNSNDTLYLQMISLRTEDTAVYYCARARGGSYQPSDYWGQGTLVTVSS

SEQ ID NO: 4816 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLFTFGPGTKVDIK

SEQ ID NO: 4817 - protein, 120 aa, Homo sapiens
QVQLVESGGGVVQPGRSLRLSCAASGFTFSSSAMHWVRQAPGRGLEWVAVISYDGSNKYYADSVKGRFTISRDNSENTVHLQMNSLRAEDTAVYYCAKALGGGYRGIDYWGQGTLVPVSS

SEQ ID NO: 4818 - protein, 107 aa, Homo sapiens
DIQMTQSPASLSASVGDRVTITCQASQDISYYLSWYQQKPGKAPQLLIYDASNFETGVPSRFTGSGSGTDFTFTISSLQPEDIATYYCQQYHNLPLTFGGGTKVEIN

SEQ ID NO: 4819 - protein, 121 aa, Homo sapiens
QVQLVESGGGVVQPGRSLRLSCAASGFTFSTYAMHWVRQAPGKGLEWVAVISYDGSNKYYADSVKGRFTISRDNSKNTLYLQMNSLRAEDTAVYYCARSYSGNYNNAFHMWGQGTMLTVSS

SEQ ID NO: 4820 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQFGGSPAYTFGQGTKLEIK

SEQ ID NO: 4821 - protein, 123 aa, Homo sapiens
QVQLQESGPGLVKPSQTLSLTCTVSGGSISSGGYYWSWIRQHPGKGLEWIGFIYYSGNTYHNPSLKSRVTISIDTSKNQFSLKLSSVTAADTAVYYCASQFGGYGSGSYYRDWGQGTLVTVSS

SEQ ID NO: 4822 - protein, 108 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYCQQRTNRPPYTFGQGTKLDIK

SEQ ID NO: 4823 - protein, 127 aa, Homo sapiens
QVQLQESGPGLVKPSETLSLTCTVSGGSISSSYWSWIRQPPGKGLEWIGYIYYSGSTKYNPSLKSRVTISVDTSKNQFSLKLSSVTAADTAVYYCARDQPETIKIFGVVASSGMDVWGQGTTVTVSS

SEQ ID NO: 4824 - protein, 107 aa, Homo sapiens
EIVMTQSPATLSVSPGERATLSCRASQSVSSNLAWYQQKPGQAPRLLIFGASTRATGIPARFSGSGSGTEFTLTISSLQSEDFSVYYCQQYNNWPFTFGQGTRLEIK

SEQ ID NO: 4825 - protein, 119 aa, Homo sapiens
EVHLVESGGGLVKPGGSLRLSCAASGFTFSSYSMNWVRQAPGKGLEWVSSISSSSSYISYADSVKGRFTISRDNAKDSLYLQMNSLRAEDTAVYYCARRSDYGEVLDYWGQGTLVTVSS

SEQ ID NO: 4826 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSPPLTFGGGTKVEIK

SEQ ID NO: 4827 - protein, 130 aa, Homo sapiens
QVQLQESGPGLVKPSQTLSLTCTVSGGSISSGGYYWSWVRQHPGKGLEWIGNIYHSGGSTYYNPSLKSRVTISIDTSKNQFSLKLNSVTAADTAIYYCASESINVVRGVPLYYYYAMDVWGLGTTVTVSS

SEQ ID NO: 4828 - protein, 110 aa, Homo sapiens
QSALTQPASVSASPGQSMTISCTGTSSDVGRYNYVSWYQQHPGKAPKLLIYDVSNRPSGVSNRFSGSKSGNTASLTISGLQAEDEADYYCSSFTSSSTWVFGGGTNLAVL

SEQ ID NO: 4829 - protein, 128 aa, Homo sapiens
EVQLVQSGAEVKKAGESLKISCKGSGYSFTNYWIGWVRQMPGKGLECMGIIYPGDSDTRYSPSFQGQVTISVDKSISTAYLQWSSLKASDTAIYSCARLTSNSGWYSSRRHLSYFDYWGQGTLVTVSS

SEQ ID NO: 4830 - protein, 108 aa, Homo sapiens
SYELTQPPSVSVSPGQTARITCSGDALPKKYAYWYQQKSGQAPVLVIYEDTKRPSGIPERFSGSISGTMATLTISGTQVEDEADYYCYSADSSANHRVFGGGTKLTVL

SEQ ID NO: 4831 - protein, 123 aa, Homo sapiens
EVELVESGGGLVKPGKSLRLSCAASGFTFSTYAMNWVRQAPGKGLEWVSCITSNSDIYYADSVKGRFTISRDNAKNSLYLQMNSLRAEDTAVYYCARARRSYTTVRLYYFDYWGQGTLVTVSS

SEQ ID NO: 4832 - protein, 108 aa, Homo sapiens
EIVMTQSPATLSVSPGGRATLSCRASQSVSSNLAWYQQKPGQAPRLLIYGASTRATGIPARFSGSGSGTEFTLTISSLQSEDFAVYSCQQYNNWPSYTFGQGTKLEIK

SEQ ID NO: 4833 - protein, 121 aa, Homo sapiens
QMQLQESGPGLVKPSETLSLTCNVSGGSITSYYWSWIRQPAGKGLEWIGRIYTSGSTNYNPSLKSRVTMSVDTSKNQFSLYLSSVTAADTAVYYCARAQLLNYYYYGMDVWGQGTTVTVSS

SEQ ID NO: 4834 - protein, 111 aa, Homo sapiens
QSVLTQPPSASGTPGQRVTISCSGSSSNIGSNIVNWYQQLPGTAPKLLIYSNNQRPSGVPDRFFGSKSGTSASLAISGLQSEDEADYYCAAWDDSLNGRYVFGTGTKVTVL

SEQ ID NO: 4835 - protein, 117 aa, Homo sapiens
EVQLVESGGGLVQPGGSLRLSCAASGFIFSTYWMTWVRQAPGKGLEWVANIKHDGSGKYHVDSVKGRFTISRDNAKNSLYLQMNSLRVEDTAVYYCTRDEGGWYDYWGQGTLVIVSS

SEQ ID NO: 4836 - protein, 111 aa, Homo sapiens
QSALTQPASVSGSPGQSITISCTGTSSDVGSYNPVSWYQQHPGKAPKVMIYEGSKRPSGVSNRFSGSKSGNTASLTISGLQAEDEADYYCCSYARSSTFMVFGGGTKLTVL

SEQ ID NO: 4837 - protein, 120 aa, Homo sapiens
QVQLVESGGGVVQPGRSLRLSCAASGFTFSNYGMHWVRQAPGKGLEWVAVIWYDGSKKYYVDAVKGRFTISRDNSKNTLYLQMNSLRAEDTAIYYCATDVPFGDSPLDVWGQGTTVTVSS

SEQ ID NO: 4838 - protein, 108 aa, Homo sapiens
SYELTQPPSVSVSPGQTARITCSGDALPKKYAYWYQQRSGQAPVLVIYEDSKRPSGIPERFSGSSSGTMATLTISGAQVEDEADYYCYSTGSSGNHYVFGTGTKVTVL

SEQ ID NO: 4839 - protein, 117 aa, Homo sapiens
EVQLVESGGGLVQPGGSLRLSCAASGIIVSSNYMSWVRQAPGKGLEWVSLLYSGGSTFYADSVRGRFTISRDNSKNTLYLQMNFLRADDTAVYYCARDLADYGMDVWGQGTTVTVSS

SEQ ID NO: 4840 - protein, 108 aa, Homo sapiens
DIQLTQSPSFLSASVGDRVTIACRASQGISSYLAWYQQKPGKAPKLLIYAASTLQSGVPSRFSGSGSGTDFTLTISSLQPEDFATYYCQQLNTSPPITFGQGTRLEMK

SEQ ID NO: 4841 - protein, 121 aa, Homo sapiens
QVQLQESGPGLVKPSQTLSLTCTVSGGSISSGTYYWSWIRQPAGKGLEWIGRIYTTGSTDYNPSLKSRVTISVDTSKNQFSLKLNSVTAADTAVYYCASDLGPAAGYFDYWGQGTLVTVSS

SEQ ID NO: 4842 - protein, 106 aa, Homo sapiens
SYELTQPPSVSVSPGQTASITCSGDKLGDKYSCWYQQKPGQSPVLVIYQDTKRPSGIPERFSGSNSGNTATLTISGTQAMDEADYYCQAWDRTTVVFGGGTKLTVL

SEQ ID NO: 4843 - protein, 118 aa, Homo sapiens
QITLKESGPTLVKPTQTLTLTCTFSGFSLSTSGVSVGWIRQPPGKALEWLALIYWDDDKRYSPSLKSRLAITKDTSKNQVVLTMTNMDPVDTATYYCAHSTPQFIDYWGQGTLVTVSS

SEQ ID NO: 4844 - protein, 105 aa, Homo sapiens
SYELTQPPSVSVSPGQTASITCSGDKLGDQYVCWYQQKPGQSPVPVIYQDNKRPSGIPERFSGSNSGNTATLTISGTQAMDEADYYCQAWDSSLVFGGGTKLTVL

SEQ ID NO: 4845 - protein, 125 aa, Homo sapiens
QVQLVESGGGVVQPGRSLRLSCAASGFTFSNYAMHWVRQAPGKGLEWVAAISYDGTNKYYADSVKGRFTISRDNSKNTLYLQMNSLRAEDTAVYYCARDNTGWVRGVIERYFDLWGRGTLVTVSS

SEQ ID NO: 4846 - protein, 107 aa, Homo sapiens
EIVLTQSPATLSLSPGERATLSCRASQSVFSYLAWYQQKPGQAPRLLIYDASDRATGIPARFSGSGSGTDFTLTISSLEPEDFAVYYCQQRSNWPLTFGGGTKVEIK

SEQ ID NO: 4847 - protein, 121 aa, Homo sapiens
EVQLVESGGGLVQPGRSLRLSCAASGFIFDDYVMHWVRQAPGKGLEWVSGINWNSGNIGYADSVRGRFTISRDNAKNSLYLQMNSLRAEDTALYYCAKDKVFSGWGAFDIWGQGTMVTVSS

SEQ ID NO: 4848 - protein, 107 aa, Homo sapiens
DIQMTQSPSTLSASVGDRVTITCRASQSIRSWLAWYQQKPGKAPKLLIYKASSLESGVPSRFSGSGSGTEFTLTISSLQADDFATYYCQQYNSFPWTFGQGTKVEIK

SEQ ID NO: 4849 - protein, 124 aa, Homo sapiens; identical to SEQ ID NO: 2871

SEQ ID NO: 4850 - protein, 108 aa, Homo sapiens; identical to SEQ ID NO: 1012

SEQ ID NO: 4851 - protein, 128 aa, Homo sapiens
QVQLVESGGGVVQPGRSLRLSCAASGFTFSSYGMHWVRQAPGKGLEWVALIYYDGSNTYYADSVKGRFTISRDNTKNTLYLQMNSLSAEDTAIYYCARDRSDEYDSSGYSYGGTFDYWGQGTLVTVSS

SEQ ID NO: 4852 - protein, 107 aa, Homo sapiens
DIQMTQSPSTLSASVGDRVTITCRASQSISSWLAWYQQKPGKAPKLLIYKASNLESGVPSRFSGSGSGTEFTLTISSLQPDDFATYYCQQYSSYSNTFGQGTKVEIK

SEQ ID NO: 4853 - protein, 118 aa, Homo sapiens
EVQLVESGGGLIQPGGSLRLSCAASGLTVSSNYMTWVRQAPGKGLEWISIIYSGGSTFYADSVKGRFTISRDNSKNTLFLQMYSLRAEDTAIYYCARNLDVAGAFDIWGQGTVVTVSS

SEQ ID NO: 4854 - protein, 106 aa, Homo sapiens
EIVLTQSPGTLSLSPGERATLSCRASQSISSSYLAWYQQKPGQAPRLLIYGASSRATGIPDRFSGSGSGTDFTLTISRLEPEDSAVYYCQQYDTWTFGQGTKVEIK

SEQ ID NO: 4855 - protein, 122 aa, Homo sapiens
QVQLVQSGAEVKKPGASVKVSCKASGYTFTSYGISWMRQAPGQGLEWMGWISSYNGNTNYAQKFQGRLTMTTDTSTSTAYMQLRSLRSDDTAVYYCARDTAQLWLKQPFDYWGQGTLVTVSS

SEQ ID NO: 4856 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKIRRVEAEDVGVYYCMQALQTLRTFGGGTKVEIK

SEQ ID NO: 4857 - protein, 120 aa, Homo sapiens
QITLRESGPTLLKPTETLTLTCTFSGFSLSTSGVSVGWFRQSPGKALEWLTLVYWSDNKRYSPSLMSRLNITKDTSKNQVVLTMTNMDPVDTGTYFCAHSRIAAAGFDPWGQGTLVIVSS

SEQ ID NO: 4858 - protein, 107 aa, Homo sapiens
DIQLTQSPSSLSASVTDRVTITCRANQTIFVYLNWYQQKVGKAPKLLIYAASELQSGVSSRFSGRGSGTEFTLTISSLQPDDFATYYCQQGYRAPYTFGQGTDLRIK

SEQ ID NO: 4859 - protein, 123 aa, Homo sapiens
QLQLQESGPGMVKPSETLSLTCTVSGGSISSNTYYWGWIRQPPGKGLEWIGNMYYSGTTYYNPSLKSRVTISVDTSKNQFSLKLNSVTAADTAVYYCARDHDILTGYDALDIWGQGTMVTVSS

SEQ ID NO: 4860 - protein, 107 aa, Homo sapiens
DIQMTQSPSSLSASVGDRVTITCRASQGIRNDLGWYQQKPGKAPKRLIYAASSLQSGVPSRFSGSGSGTEFTLTISSLQPEDFATYYCLQHNTYPLTFGGGTKVEIK

SEQ ID NO: 4861 - protein, 120 aa, Homo sapiens
QLQLQESGPGLVKPSETLSLTCTVSGDSISSSSYYWGWIRQPPGKGLEWIGSIYHIGTTYDNPSLKSRVTISVDTSKNQFSLKLISVTAADTAVYYCARPLTVTMPFAYWGQGILVTVSS

SEQ ID NO: 4862 - protein, 106 aa, Homo sapiens
DIQMTQSPSTLSASVGERVTITCRASQSIDKWLAWYQQKPGKAPKLLIYKASSLESGVPSRFSGSGSGTEFTLTISSLQPDDFATYYCQQYNSYSTFGQGTKLEIK

SEQ ID NO: 4863 - protein, 121 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCVHRGGMLYYFFDYWGQGTLVTVSS

SEQ ID NO: 4864 - protein, 107 aa, Homo sapiens
DIQMTQFPSSLSASVGDRVTITCRTSQSIGSFLNWYQQKPGKAPKLLISAASSLQSGVPSRFSGGGSGTDFTLTISSLQPEDFATYYCQQSYSTPWTFGQGTKMEIK

SEQ ID NO: 4865 - protein, 121 aa, Homo sapiens
QVQLVESGGGVVQPGRSLRLSCAASGFTFSTYAMHWVRQAPGKGLEWAAIISYDGINKYYADSVRGRFTISRDNSKNTLYLQMNSLRPEDTAVFYCARATSGSYYRSMDVWGQGTTVTVSS

SEQ ID NO: 4866 - protein, 111 aa, Homo sapiens
QSALTQPASVSGSPGQSITISCTGTSSDVGGYNFVSWYQQHPGKAPKLMIFDVSNRPSGVSNRFSGSKSGNTASLTISGLQAEDEAEYYCSSYTSSTTLYVFGRGTKVTVL

SEQ ID NO: 4867 - protein, 124 aa, Homo sapiens
QVQLVQSGAEVKKPGASVKVSCKASGYTFIGYYIHWVRQAPGQGLEWMGWINPISGVTKYAQKFQGKITMTRDTSISTAYMELSRLRSDDTAVYYCAREIAAADGHFYYGLDVWGQGTTVTVSS

SEQ ID NO: 4868 - protein, 107 aa, Homo sapiens
EIVLTQSPGILSLSPGERATLSCRASQSVSSSYLAWYQQKPGQAPRLLIYGASTRATGIPDRFSGGGSGTDFTLTISRLEPEDFAVYYCQQYDSSPLFGPGTTVAIK

SEQ ID NO: 4869 - protein, 120 aa, Homo sapiens
QLQLQESGPGLVKPSETLSLTCTVSGGSISSSSYYWGWIRQPPGKGLEWIGTMYYSGSTYYNPSLKSRVTISVDTSKNQFSLKLTSMTAADTAVYYCARVRQWLVPFDYWGQGTLVTVSS

SEQ ID NO: 4870 - protein, 106 aa, Homo sapiens
SYELTQPPSVSVSPGQTASITCSGDKLENKYVCWYQQKPGQSPVLVIYQDTKRPSGIPERISGSSSGNTATLTISGTQAMDEAHYYCQAWASSTAVFGGGTKLTVL

SEQ ID NO: 4871 - protein, 122 aa, Homo sapiens
QMQLVQSGAEVKKTGSSVKVSCKASGYTFTYRYLHWVRQAPGHALEWMGWITPFNGDTHYAQKFQDRVTVTRDRSMGTAYLELSSLRSDDTAMYYCASGPIVATTNDAFDIWGQGTMVTVSS

SEQ ID NO: 4872 - protein, 110 aa, Homo sapiens
QSVLTQPPSVSAAPGQKVTISCSGSNSNIGSNFVSWYQQLPGTAPKLLIYDNNKRPSGVPDRFSGSKSGTSATLGITGLQTGDEADYYCGTWDSSLSAYVFGTGTKVTVL

SEQ ID NO: 4873 - protein, 129 aa, Homo sapiens
QVQLVESGGGVVQPGRSLRLSCAASGFTFSGYGMHWVRQAPGKGLEWVALISHDGSNRYYADSVKGRFTISRDNSKNTLYLQMNSLRAEDTALYYCAKDRLGYCSSPNCPGGSNWFDPWGQGTLVTVSS

SEQ ID NO: 4874 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRGFGQGTRLEIN

SEQ ID NO: 4875 - protein, 112 aa, Homo sapiens
QVQLQESGPGLVKPSETLSLTCNVSGDSISGYYWSWIRQPPGKGLEWIGYIYYSGSTTYNPSLKSRVTISVDTSKNQFSLNLSSVTAADTAVYYCARGFDYWGQGTLVTVSS

SEQ ID NO: 4876 - protein, 108 aa, Homo sapiens
EIVLTQSPGILSLSPGERATLSCRASQSVSSIYLAWYQQKPGQAPRLLIYGASSRAIGIPDKFSGSGSGTDFTLTINRLEPEDFAVYYCQQYGSSPWTFGQGTKVEIK

SEQ ID NO: 4877 - protein, 121 aa, Homo sapiens
QVQLVQSGSELRKPGASVKVSCKASGYTFTTHGMSWVRQAPGQGLEWMGWINTNTGNPTYAQDFTGRFVFSVDSSVSTAYLQISSLKAEDTAVYYCAREHFRAAAIAFDYWGQGTLVTVSS

SEQ ID NO: 4878 - protein, 106 aa, Homo sapiens
DIQMTQSPSSLSASVGDRVTITCRASQSISRYLNWYQQKPGKAPELLIYTTSTLQSGVPSRFSGSGSETEFTLTISSLQPEDFATYYCQQTYSTRTFGQGTKVEIK

SEQ ID NO: 4879 - protein, 120 aa, Homo sapiens
QVHLVESGGGVVQPGRSLRLSCAASGFTLRSYAMHWVRQAPGKGLEWVALISYDGSVKKYAESVKGRITVSGDNSRNTLHLEINTLRADDTAVYYCVRGGVSGPNSFGLWGQGTMVTVSS

SEQ ID NO: 4880 - protein, 112 aa, Homo sapiens; identical to SEQ ID NO: 674

SEQ ID NO: 4881 - protein, 126 aa, Homo sapiens
QVQLVQSGAEVKKPGASVKVSCKASGYTFSDHYMHWVRQAPGQGLEWMGWINPISGVTNPAQKFQGRVTMTRDTSISTAYMELTRLRSDDTAVYYCARESSLAYYSDTSGSLIDYWGRGTLVTVSS

SEQ ID NO: 4882 - protein, 109 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLHVVFGGGTKLTVL

SEQ ID NO: 4883 - protein, 112 aa, Homo sapiens
QVQLQESGPGLVKPSETLSLTCTVSGDSISPYYWSWIRQPPGKGLEWIGYIYYSGRTNYNPSLKSRVTISVDTSKNQFSLKLTSVTAADTAIYYCARDFSNWGQGTLVTVSS

SEQ ID NO: 4884 - protein, 109 aa, Homo sapiens
EIVLTQSPGILSLSPGERATLSCRASQSVSSNYLAWYQQKPGQAPRLLIYAASSRAIGVPDRFSGSGSGTDFTLTISRLEPEDFAVYYCHQYGSSLTWTFGQGTKVEIK

SEQ ID NO: 4885 - protein, 121 aa, Homo sapiens
QVQLVESGGGVVQPGRSLRLSCAASGFTFSTYAMHWVRQAPGKGLEWVAVISYDGSNKYYADSVKGRFTISRDNSKNTLYLQMNSLRAEDTAVYYCARSLGGGYTYGSDYWGQGTLVTVSS

SEQ ID NO: 4886 - protein, 105 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFGGGTKVEIK

SEQ ID NO: 4887 - protein, 123 aa, Homo sapiens
QVQLRESGPGLVKPSETLSLTCTFSGDSISTYYWSWIRQPPGKGLEWIGYIFYSGSTKYNPSLKSRVTMSADTSKNQFSLRLSAVTAADTAVYYCATSGNQHADSSGYYFDYWGQGTLVTVSS

SEQ ID NO: 4888 - protein, 108 aa, Homo sapiens
EIVLTQSPATLSLSPGERATLSCRASQSVSSYLAWYQQKPGQAPRLLIYDASKRATGIPARFSGSGSGTDFTLTISSLEPEDFAVYYCQQRSNWLPLTFGGGTNVEIK

SEQ ID NO: 4889 - protein, 121 aa, Homo sapiens
QVQLVESGGGVVQPGRSLRLSCAASGFTFSSYAMHWVRQAPGKGLEWVALISYDGSNKYYADSVKGRFTISRDNSKNTLYLQMNSLRAEDTAVYYCARATGGNYYYGMDVWGQGTTVTVSS

SEQ ID NO: 4890 - protein, 108 aa, Homo sapiens
DIQLTQSPSFLSTSVGDRVTITCRASQGISSYLAWYQQKPGKAPKLLIYAASTLQSGVPSRFSGSGSGTEFTLTISSLQPEDFATYYCQQLNSYPPYTFGQGTKLEIK

SEQ ID NO: 4891 - protein, 128 aa, Homo sapiens
QVQLVQSGAEVRKPGASVKVSCKVSGYTLTELSMHWVRQAPGKGLEWMGGFDPEDGERMYAQKFQGRVTMTEDTSTDTAYMELSSLRSEDTAIYYCTTDLSYLWSGKLEPDYWYFALWGRGTLVTVSS

SEQ ID NO: 4892 - protein, 113 aa, Homo sapiens
DIVMTQSPDSLAVSLGERATINCKSSQSVLYSSNNKNYLAWYQQKPGQPPKLLISWASTRESGVPDRFSGSGSGTEFTLTISSLQAEDVAVYYCQQYYGTPLTFGQGTKLEIK

SEQ ID NO: 4893 - protein, 121 aa, Homo sapiens
QVQLVESGGGVVQPGRSLRLSCAASGFTFSTYGMHWVRQAPGKGLEWVAVIFFDGSKTYYADSVKGRFTISRDNSKNTLYLQMNSLRAEDTAVYYCAKETYGDYDQAMAYWGQGTLVTVSS

SEQ ID NO: 4894 - protein, 108 aa, Homo sapiens
SYVVTQPPSVSVAPGKTAMITCGGNNIGSKSVHWYQQKPGQAPVLVIYFDSDRPSGIPERFSGANSGNTATLTISRVEAGDEAEYYCHVWDSSSDHGVFGGGTKLTVL

SEQ ID NO: 4895 - protein, 131 aa, Homo sapiens
EVQLVESGGGLVQPGGSLRLSCAASGFTFSSYWMSWVRQSPGKGLEWVANIRHDGSEKYYVDSVKGRFTISRDNAKNSLYLQMNSLRAEDTAVYYCARVSRFYARAGESGGYYYYYGMDVWGQGTTVTVSS

SEQ ID NO: 4896 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAIYYCQQYGNSPPYTFGQGTKLEIK

SEQ ID NO: 4897 - protein, 126 aa, Homo sapiens
QVQLVQSGAEVKKPGASVTVSCKASGYSFTTYYMHWVRQAPGQGLEWMGVINPSDGSTNYAQKFQGRVTMTRDTSTSTIYMDLSSLRSDDSAVYYCARDLTVTTGVLDYYYGLDFWGQGTTVIVSS

SEQ ID NO: 4898 - protein, 108 aa, Homo sapiens
SYELTQPPSVSVSPGQTARITCSGDALPKQFAHWYQQKPGQAPVVVISKDTERPSGIPERFSGSSSGTTVTLTIRGVQAEDEADYYCQSADSSGTYVVFGGGTKLTVL

SEQ ID NO: 4899 - protein, 124 aa, Homo sapiens
QVQLQESGPGLVKPSQTLSLTCTVSGGSISSDDYYWSWIRQHPGKGLEWIGYIYYSGSTYYNPSLKSRVTISVDTSKNQFSLKLSSVTAADTAVYYCARVRGYCSSTRCHVDYWGQGTLVTVSS

SEQ ID NO: 4900 - protein, 109 aa, Homo sapiens
EFVLTQSPATLSLSPGERATLSCRASQSVSSYLAWYQQKPGQPPRLLIYDASNRATGIPTRFSGSGSGTDFTLTIGSLEPEDFAVYYCQQRSDWPPGITFGQGTRLEIK

SEQ ID NO: 4901 - protein, 121 aa, Homo sapiens
QVQLVESGGGVVQPGRSLRLSCAASGFTFSTYAIHWVRQAPGKGLEWVAVISYDGINNYYADSVKGRFTISRDNSKNTLYLQMNSLRTEDTAVYYCARTHGGSYRSAFDIWGQGTIVTVSS

SEQ ID NO: 4902 - protein, 108 aa, Homo sapiens
EIVMTQSPTTLSLSPGERATLSCRASQSVSSNLAWYQQKPGQAPRLLIYGASTRATGIPARFSGSGSGTEFTLTISSLQSEDFAIYYCHQYNNWPPITFGQGTRLEIK

SEQ ID NO: 4903 - protein, 119 aa, Homo sapiens
QVQLVQSGAEVKKPGASVKVFCKASGYTFTSQYVHWVRQAPGQGLEWMGLINPDGDTTSSAQKFQGRVTMTRDTSTTTVYMELSSLRSEDTAVYYCTSSTWLRGGMDVWGQGTRVTVSS

SEQ ID NO: 4904 - protein, 111 aa, Homo sapiens
NFLLTQPHSVSESPGKTVTISCTGSSGYIASNYVQWYQQRPGSAPTIVIYEDNQRPSGVPDRFSGSIDSSSNYASLTISGLKTEDEADYYCQSYHSSNHVVFGGGTKLTVL

SEQ ID NO: 4905 - protein, 129 aa, Homo sapiens
EVQLVQSGAEVKKPGATVKISCKVSGYTFTDYYMHWVQQAPGKGLEWMGLIDPEDDETISAERFKGRVTITADTSTDTVYMELSSLRSEDTAVYYCARESRSLGYCTAGSCYSYSFDPWGQGTLVTVSS

SEQ ID NO: 4906 - protein, 109 aa, Homo sapiens
EIVLTQSPGTLSLSPGERATLSCRASQSVSSSYLAWYQQKPGQAPRLLIHGSSSRATGIPDRFSGSGSGTDFTLTISRLEPEDFAVYYCQQYGSSSSITFGQGTRLEIK

SEQ ID NO: 4907 - protein, 120 aa, Homo sapiens
QVQLVESGGGVVQPGRSLRLSCAASGFTFITYGMHWVRQAPGKGLEWVAVISYDGNNRYYADSVRGRFTISRDNSKNTLYLQMISLRGEDTAVYYCARDQAAVAGPIDYWGQGTLVTVSS

SEQ ID NO: 4908 - protein, 106 aa, Homo sapiens
SYELTQPPSVSVSPGQTASITCSGDKLENKYASWYQQKPGQSPLLVIYQDDKRPSGIPERFSGSSSGNTATLTISETQAMDEADYYCQAWGSSSVVFGGGTKLTVL

SEQ ID NO: 4909 - protein, 117 aa, Homo sapiens
QVQLVESGGGVVQPGRSLRLSCAASGFTFSSYAMHWVRQAPGKGLEWVALISYDGTNKYYADSVKGRITISRDNSKNTLYLQMNSLRAEDTAVYYCARDLGSGWSPWGQGTLVTVSS

SEQ ID NO: 4910 - protein, 106 aa, Homo sapiens
SYELTQPPSVSVSPGQTASITCSGDNLGDKYVCWYQQKPGQSPVLVIYQDSKRPSGIPERFSGSTSGNTATLTISGTQTMDEADYYCQAWDSRAAVFGGGTKLTVL

SEQ ID NO: 4911 - protein, 121 aa, Homo sapiens
QVQLVESGGGVVQPGRSLRLSCAASGFTFSIYAMHWVRQAPGKGLEWVAVISYDGINKYYADSVKGRFTISRDNSKNTLYLQINSLRTEDTAVFYCAKSRGGSYSNAFDIWGQGTMVTVSS

SEQ ID NO: 4912 - protein, 107 aa, Homo sapiens
EIVLTQSPGTLSLSPGERATLSCRASQSVSSSYVAWYQQKPGQAPRLLIYGASSRATGIPDRFSGSGSGTDFTLTISRLEPEDFAVYYCQQYHLGLTFGGGTKVEIK

SEQ ID NO: 4913 - protein, 119 aa, Homo sapiens
QVQLVQSGAEVKKPGASVKVSCKTSGYTFTAYYLQWVRQAPGQGLEWMGWIHPNSGGTNYAQKFQGRVTMTRDTSISTAYMELSSLRSDDTAVYYCARDLAVAGCFDYWGQGTLVTVSS

SEQ ID NO: 4914 - protein, 108 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPIFTFGPGTKVDVK

SEQ ID NO: 4915 - protein, 127 aa, Homo sapiens
QVQLVESGGGVVQPGRSLRLSCAASGYIFSSYAVHWVRQAPGKGLEWVAVISYDGSNKYYADSVKGRFTISRDNSKNTLHLQMNSLRAEDTAVYYCARDTPHYYSDSKNFHYGMDVWGQGTTVTVSS

SEQ ID NO: 4916 - protein, 107 aa, Homo sapiens
DIQMTQSPSSLSASVGDRVTITCRASQSISLYLNWYQQKPGKAPNLLIYAASSLQSGVPSRFSGSGSGTDFTLTVSSLQPEDFATYYCQQTYSTPLTFGGGTKVEIK

SEQ ID NO: 4917 - protein, 120 aa, Homo sapiens
EVQLVESGGDLIQPGGSLRLSCAASGVTVTRNYMSWVRQAPGKGLEWVSVIYPGGSTFYADSVRGRFTISRDNSKNTLYLQMNSLRAEDTAVYYCARDTVAAGTETFDSWGQGTLVTVSS

SEQ ID NO: 4918 - protein, 103 aa, Homo sapiens
DIQMTQSPSSLSASVGDRVTITCRPSQSISNYLNWYQHKVGKTPKLLIYGASTLQSGVPSRFSGGGSGTDFTLTISSLQPEDFATYYCQHGLTFGQGTKLEIK

SEQ ID NO: 4919 - protein, 125 aa, Homo sapiens
QVHLVQSGAEVKKPGASVKVSCKVSGYTLIELSMHWVRQAPGKGLEWMGGFDPEDAETIYAEKFQGRVSMTEDTSTDTAYMELSSLRSEDTAVYYCATAPAAFYGSGYYYGMDVWGQGTTVTVSS

SEQ ID NO: 4920 - protein, 112 aa, Homo sapiens
DIVMTQTPLSSPVTLGQPASISCRSSQSLVHSDGNTYLSWLQRRPGQPPRLLIYKISNRFSGVPDRFSGSGAGTDFTLKISRVEAEDVGVYYCMQATQFPLTFGGGTKVEIK

SEQ ID NO: 4921 - protein, 131 aa, Homo sapiens
QVQLVESGGGVVQPGKSLRLSCAASGFTFSTYTIHWVRQAPGRGLEWVAAISYDGSDKYYADSVKGRFTISRDNSKNTLYLQMSSLRPEDTAVYYCGRDRQYYDILTDYYLPTSEYYFDYWGQGTLVTVSS

SEQ ID NO: 4922 - protein, 107 aa, Homo sapiens
DIQMTQSPSSVSASVGDRVTITCRASQGINSWLAWYQQKPGKAPQLLIYSASSLQSGVPSRFSGSGSGTDFTLTISNLQPEDFATYSCQQAHSFPPTFGGGTKVEIK

SEQ ID NO: 4923 - protein, 121 aa, Homo sapiens
QLQLQESGPGLVKPSETLSLSCTVSGGSLSSSFHYWGWIRQPPGKGLAWIGNIYYSGSTDYNPSLKSRVTISIDTSKNQFSLKLSSVTAADTAVYYCARLGSGSYYTLDYWGQGILVTVSS

SEQ ID NO: 4924 - protein, 109 aa, Homo sapiens
DIQMTQSPSSLSASVGDRVTITCQASQDISNYLNWYQQKPGKAPKLLIYDASNLETGVPSRFSGSGSGTDFTLTISSLQPEDIATYYCQQYENLPPGLTFGGGTKVEIK

SEQ ID NO: 4925 - protein, 125 aa, Homo sapiens
EVQLVESGGGLVKPGGSLRLSCVASGFTFSNYRMNWVRQAPGKGLEWVSSISSSPSYIYYADSVKGRFTISRDNAKNSLYLQMNSLRAEDTAVYYCARDPVDTPMVLGVGFFDYWGQGTLVTVSS

SEQ ID NO: 4926 - protein, 107 aa, Homo sapiens
EIVMTQSPATLSVSPGERATLSCRASQSVGSNLAWYQQKPGQAPRLLIYGASTRATGVPARFSGSGSGTEFTLTISSLQSEDLAVYYCQQYNIWLWTFGQGTKVEIK

SEQ ID NO: 4927 - protein, 129 aa, Homo sapiens
EVQLVQSGAEVKKPGESLKISCKGSGYSFTSKWIGWVRQMPGKGLEWLGVIYPGDSDTRYGPSFQGQVTISADKSTSTAYLQWSSLKASDTAMYYCARRSYYYASGSFYKAGTSAFDIWGQGTMVTVSS

SEQ ID NO: 4928 - protein, 111 aa, Homo sapiens
QSVLTQPPSVSGAPGQRVTISCTGSSSNIGAGYDVHWYQQPPGTAPKLLIYGNSNRPSGVPDRFSGSKSGTSASLAITGLQAEDEADYYCQSYDSSLSGSVFGTGTKVTVL

SEQ ID NO: 4929 - protein, 120 aa, Homo sapiens
QVQLQESGPGLVKPSGTLSLTCAVSGGSISSSNWWSWVRQPPGKGLEWIGEIYHSGSTNYNPSLKSRVTISVDKSKNQFSLKLNSVTAADTAMYYCARAWSSSQRGFDPWGQGTLVSVSS

SEQ ID NO: 4930 - protein, 110 aa, Homo sapiens
QSALTQPASVSGSPGQSITISCTGTSSDVGSYNVVSWYQQHPGKAPKLMIYDVSKRPSGVSNRFSGSKSGNTASLTISGLQAEDEADYYCCSYVGSSTWVFGGGTKLTVL

SEQ ID NO: 4931 - protein, 127 aa, Homo sapiens
EVQLLESGGGLVQPGGSLRLSCAASGFNFSSYAMTWVRQAPGKGLEWVSGISGSGSSTYYAESVKGRITISRDNSKKTLSLQLNSLRAEDTAVYYCAKDRPFYDILTGLPGYGMDVWGQGTTVTVSS

SEQ ID NO: 4932 - protein, 107 aa, Homo sapiens
DIQMTQSPSSVSASVGDRVTITCRASQGISSWLAWYQQKPGKAPKLLIYAASILQSGVPSRFSGSGSGTDFTLTISSLQPEDFATYYCQQANSIPLTFGGGTKVEIK

SEQ ID NO: 4933 - protein, 121 aa, Homo sapiens
QVHLVESGGGGVQPGRSLRLSCAASGFTFMTYAMHWVRQAPGKGLEWVAVISYDGNNRYYADSVRGRFTISRDNSKNTLYLQMNSLRAEDTAVYYCARSRGGSYSNAFDIWGQGTMVTVSS

SEQ ID NO: 4934 - protein, 107 aa, Homo sapiens
EIVLTQSPGTLSLSPGERATLSCRASQTVSSTYLAWYQQKPGQAPRLLIYGASSRASGIPDRFSGSGSGTDFTLTISRLEPEDFAVYYCLQYQLGFTFGGGTKVEIK

SEQ ID NO: 4935 - protein, 127 aa, Homo sapiens
QVQLQESGPGLVKPSQTLSLTCTVSGGSVSSGDYYWSWIRQPPGRGLEWIGFIYYSGSTYYNPSLKSRVTISVDTSKNQFSLKLTSVTAADTAVYYCAREPFRARRDLPGGGGMDVWGQGTTVTVSS

SEQ ID NO: 4936 - protein, 113 aa, Homo sapiens
DIVMTQSPDSLAVSLGERATINCKSSQSVLYSSNNKNYLAWYQQKPGQPPRLFIYWASTRESGVPDRFSGSGSGTDFTLTISSLQAEDVAVYYCQQYYNTPRTFGQGTKVEIK

SEQ ID NO: 4937 - protein, 121 aa, Homo sapiens
QVHLVESGGGVVQPGRSLRLSCAASGFTFSTYAMHWVRQAPGKGLEWVALISYDAGNKYYADSVKGRFTISRDNYKNTLDLQVNSLRPEDTAVYYCARGRGGSYFYGMDVWGQGTTVTVSS

SEQ ID NO: 4938 - protein, 107 aa, Homo sapiens
DIQMTRSPSSVSASVGDRVTITCRASQGISTYLAWYQHKPGTAPKLLIYAASSLQSGVPSRFSGSGSGTDFTLTISNLQPEDFATYYCQQTNSFPQTFGGGTKVEIK

SEQ ID NO: 4939 - protein, 121 aa, Homo sapiens
QVQLQESGPGLVKPSQTLSLTCTVSGDSISSGGYYWSWIRQHPGKGLEWIGYIFYSGSTYYNPSLKSRVTISVDTSKNQFSLKLSSVTAADTAVYYCARDSVAGFSIFDFWGQGTLVTVSS

SEQ ID NO: 4940 - protein, 108 aa, Homo sapiens
SSELSQDPAVSVALGQTVRITCQGDSLRSYYASWFQQKPGQAPVRVIYGKNNRPSGIPDRFSGSSSGNTASLTITGAQAEDEADYYCNSWDSSTNHVLFGGGTKLTVL

SEQ ID NO: 4941 - protein, 125 aa, Homo sapiens
QLQLQESGPGLVKPSETLSLTCTVSGGSIRSSSYYWGWIRQPPGKGLEWIGSIYYSGSTYFNPSLKSRVTISVDTSKNQFSLKLSSVTAADTAVYYCAILWFGKSVYYYYDMDVWGQGTTVTVSS

SEQ ID NO: 4942 - protein, 111 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLWVFGGGTKLTVL

SEQ ID NO: 4943 - protein, 124 aa, Homo sapiens
QVQLVQSGAEVKKPGASVKVSCKTSGYTFTFYGITWVRQAPGQGLEWMGWISAYTGNTSYAQKLQGRVTLTTHTSTSTVYMELRSLRSDDTAVYYCARGVFTGFYRAPNGMDVWGQGTTVTVSS

SEQ ID NO: 4944 - protein, 111 aa, Homo sapiens
QSALTQPASVSGSPGQSITISCTGTSSDVGGYNYVSWYQQHPGKAPKLMIYEVSNRPSGVSNRFSGSKSGHTASLTISGLQAEDEADYYCSSYTSSSTLYVFGTGTKVTVL

SEQ ID NO: 4945 - protein, 123 aa, Homo sapiens
QVQLQQWGAGLLKPSETLSLTCAVYGGSFSGYFWSWIRQPPAKGLEWIGDINHSGSTNYNPSLKSRVTISVDTSKNQFSLKLSSVTAADTAVYYCARGEPKFYYSGSGGYSSWGQGTLVTVSS

SEQ ID NO: 4946 - protein, 108 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNYWPPITFGQGTRLEIK

SEQ ID NO: 4947 - protein, 126 aa, Homo sapiens
QVQLVESGGGVVQPGRSLRLSCAASGFTFSSYAMHWVRQAPGKGLEWVAVISYSGSNKYYADSVKGRFTISRDSSKNTLYLQMNSLRAEDTAVYYCARDSLGLHDTGGTDNYFDYWGQGTLVTVSS

SEQ ID NO: 4948 - protein, 106 aa, Homo sapiens
EIVMTQSPATLSVSPGERATLSCRASQSVSSNLAWYQQKPGQAPRLLIYGVSTRATGIPARFSGSGSGTEFTLTISSLQSEDFAVYYCQQYNNWWTFGQGTKVEIK

SEQ ID NO: 4949 - protein, 119 aa, Homo sapiens
QITLKESGPTLVKPTQTLTLTCTFSGFSLSISGVGVGWLRQPPGKALEWLALIYWDDDKRYSPSLKSRLTISKDTSKNQVVLKMTNIDPVDTATYYCAHHSISTIFDHWGQGTLVTVSS

SEQ ID NO: 4950 - protein, 109 aa, Homo sapiens
QSALTQPASVSGSPGQSITISCTATSSDVGDYNYVSWYQQHPGKAPKLMIFEVSDRPSGISNRFSGSKSGNTASLTISGLQAEDEADYYCSSYTTSSAVFGGGTKLTVL

SEQ ID NO: 4951 - protein, 121 aa, Homo sapiens
QVQLVESGGGVVQPGRSLRLSCAASGFTFSSFAMHWVRQAPGKGLEWVAVISYDGSHKYYADSVKGRVTISRDNSKNTLYLQMNSLRVEDTAVFYCAKDDCGGGVCFPDYWGQGTLVTVSS

SEQ ID NO: 4952 - protein, 110 aa, Homo sapiens
QSALTQPASVSGSPGQSITISCTGTSSDVGGYNYVSWYQQHPGKAPKLMIFEVKIRPSGVSDRFSGSRSGNTASLTISGLQAEDEAAYYCSSYTSSSTLVFGGGTKLTVL

SEQ ID NO: 4953 - protein, 118 aa, Homo sapiens
QVQLQESGPGLVKPSETLSLTCTVSGGSISSYYWSWIRQPPGKGLEWIGYIYYSGSTNYNPSLKSRITISLDTSKNQFSLKLSSVTAADTAVYYCATINYADYALDYWGQGTLVTVSS

SEQ ID NO: 4954 - protein, 109 aa, Homo sapiens
NFMLTQPHSVSEAPGKTVTISCTGSSGSVASNYVQWYQQRPGSAPTTVIYEDNQRPSGVPDRFSGSIDSSSNSASLTISGLKTEDEADYYCQSYDSSVVFGGGTKLTVL

SEQ ID NO: 4955 - protein, 124 aa, Homo sapiens
QVQLVESGGGVVQPGRSLRLSCAASGFTFSTYAIHWVRQAPGKGLEWVAVISYDGSNKYYADSVKGRFTISRDDSKNTLYLQMNSLRAEDTAVYYCARDVATYNRYYYFGMDVWGQGTTVTVSS

SEQ ID NO: 4956 - protein, 110 aa, Homo sapiens
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGLVFGTGTKVTVL

SEQ ID NO: 4957 - protein, 122 aa, Homo sapiens
QVQLQESGPGLVKPSETLSLTCTVSGGSVSSGSYYWSWIRQPPGKGLEWIGYIYYSGNTNYNPSLKSRVTISVDTSKNQFSLKLSSVTAADTAVYYCARAPVATFYMIFDYWGQGTLVTVSS

SEQ ID NO: 4958 - protein, 106 aa, Homo sapiens
DIQMTQSPSSLSASVGDRVTITCRASLSIRNYLNWYQQKPGKAPKLLIYAASSLQSGVPSRFSGSGSGTDFTLTISSLQPEDFATYYCQQSYNTLTFGPGTKVDIK

SEQ ID NO: 4959 - protein, 117 aa, Homo sapiens
EVQLVESGGGLIQPGGSLRLSCAASGVTVSSNYMNWVRQAPGKGLEWVSVIYSGGSTFYADSVKGRFTISRDNSRNTLYLQMNSLRAEDTAVYYCARDGYFYGMDVWGQGTTVTVSS

SEQ ID NO: 4960 - protein, 106 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQVNSYPIFGPGTKVDIK

SEQ ID NO: 4961 - protein, 128 aa, Homo sapiens
QVQLVQSGSELKKPGASVKVSCKASGYTFTNYAMNWVRQAPGQGLEWMGWINTNTGNPTYAQGFTGRFVFSLDTSVSTAYLQISSLKAEDTAMYYCASTAFLERSSYWQAMADYFDYWGQGTLVTVSS

SEQ ID NO: 4962 - protein, 111 aa, Homo sapiens
QSALTQPPSASGSPGQSVTISCTGTSSDVGGYNSVSWYQQHPGKAPKLMIYEVTKRPSGVPDRFSGSKSGNTASLTVSGLQGDDEADYYCSSYVGSSNSVVFGGGTKLTVL

SEQ ID NO: 4963 - protein, 124 aa, Homo sapiens
QVQLQESGPGLVKPSETLSLTCTVSGGSISTYYWSWIRQPPGKGLEWIGYIFYSGSTNYNPSLKSRVTISMDTSKNQFSLKLSSVTAADTAVYYCARHQAIYYSGSGNCWFDPWGQGTLVTVSS

SEQ ID NO: 4964 - protein, 108 aa, Homo sapiens
SSELTQDPAVSVALGQTVRITCQGDSLRSNYASWYQQKPGQAPVRVIYGRDNRPSGIPDRFSGSSSGNTASLTITGAQAEDEADYYCNSWDSSGNHVVFGGGTKLTVL

SEQ ID NO: 4965 - protein, 123 aa, Homo sapiens
EVHLVESGGGLVQPGRSLRLSCAASGFTFDDYAMHWVRQVPGKGLEWVSGISWNSGSIHYADSVKGRFTISRDNAKNSLYLQMNSLRAEDTALYYCTKGRFLEWLPRGAIDYWGQGTLVTVSS

SEQ ID NO: 4966 - protein, 117 aa, Homo sapiens
QPVLTQPPSASASLGASVTLTCTLSSDYSNYKVDWYQQRPGKGPRFVMRVGTGEIVGSKGHGIPDRFSVLGLGLNRYLTIKNIQEEDESDYHCGADHGSGSNFVPWVFGGGTKLTVL

SEQ ID NO: 4967 - protein, 122 aa, Homo sapiens
QVQLQESGPGLVKPSETLSLTCTVSDGSISNYYWSWIRQPPGKGLEWIGYLYYSGSTNYNPSLKSRVSISVDTSKNQFSLKLYSVTTADTAVYYCARVRFGELLWEKYFDYWGQGTLVTVSS

SEQ ID NO: 4968 - protein, 107 aa, Homo sapiens
DIQMTQSPSTLSASVGDRVTITCRASQSISSWLAWYQQKPGKAPNLLIYKASSLESGVPSRFSGSGSGTEFTLTISSLQPDDFATYYCQQYKNYFPTFGQGTKVEIR

SEQ ID NO: 4969 - protein, 119 aa, Homo sapiens
QITLKESGPTLVKPTQTLTLTCSFSGFSLSTSGVGVGWIRQPPGKALEWLALIYWDGDKRYSPSLKSRLTITKDTSKNQVVLTMTNMDPVDTATYYCAHRRAIFEFDPWGQGTLVTVSS

SEQ ID NO: 4970 - protein, 107 aa, Homo sapiens
SYELTQPPSVSVSPGQTASITCSGDKLGDIYTYWYQQKPGQSPVLVIYQDSKRPSGIPERFSGSSSGNTATLTISGTQAMDEADYYCQAWDGNTAVVFGGGTKLTVL

SEQ ID NO: 4971 - protein, 122 aa, Homo sapiens
QVQLVESGGGVVQPGRSLRLSCAASGFTFSNYAMHWVRQAPGKGLEWVALISYDGTNKYYADSVKGRFTISRDNSKNTLYLQMNSLRAEDTAVYYCAKLQGSGSYYNPIDYWGQGTLVTVSS

SEQ ID NO: 4972 - protein, 107 aa, Homo sapiens
EIVLTQSPGTLSLSPGERATLSCRASQSVTSSYLAWYQQKPGQAPRLLIYGASSRATGIPDRFSGSGSGSDFTLTISRLEPEDFAVYYCQQYGSSYTFGQGTKLEIK

SEQ ID NO: 4973 - protein, 120 aa, Homo sapiens
EVQLVQSGAEVKKPGESLKISCKGSGYSFTNYWIGWVRQMPGKGLEWMGIIHPSDSDTRYSPSFQGQVTISVDKSLSTAHLQWSSLKASDTAMYYCARHHDYYDISGYIWGQGTMVTVSS

SEQ ID NO: 4974 - protein, 109 aa, Homo sapiens
SYELTQPPSVSVSPGQTARITCSGDALPKQYAYWYQQKPGQAPKLVIYKDSERPSGIPERFSGSSSGTTVTLTISGVQAEDEADYHCQSADFSGSYPVVFGGGTKLTVL

SEQ ID NO: 4975 - protein, 129 aa, Homo sapiens
QVQLVESGGGVVQPGKSLRLSCTASGFTFSSYAMHWVRQAPGKGLEWVAVILYDGTDEYYADSVKGRFTISRDNSKHTLYLQMNSLRTEDTAVYYCARDAAAGIGEWLVTSPSCYFDYWGQGTLVTVSS

SEQ ID NO: 4976 - protein, 107 aa, Homo sapiens
DIQMTQSPSTLSASVGDRVTITCRASQSISSWLAWYQQKPGKAPNLLMYKASSLESGVPSRFSGSGSGTEFTLTISSLQPDDFATYYCQQYNSYPGTFGQGTKVEIK

SEQ ID NO: 4977 - protein, 120 aa, Homo sapiens
QVQLVESGGGVVQPGRSLRLSCAASGFTFSTYAMHWVRQAPGKGLEWVALISYDGINKYYADSVRGRFTFSRDNSKNTLYLQMNTLRPEDTAVYYCARGGSGTYYYFDQWGQGTLVTVSS

SEQ ID NO: 4978 - protein, 110 aa, Homo sapiens
QSVLTQPPSVSGAPGQRVTISCTGSSSNIGAGYDVHWYQLLPGTAPKLLIYRNNNRPSGVPDRFSGSNSGTSASLAITGLQAEDEADYYCQSFDSSVNQVFGGGTKLTVL

SEQ ID NO: 4979 - protein, 127 aa, Homo sapiens
QVQLVESGGGVAQPGRSLRLSCAASGFTFSHYGMHWVRQAPGKGLEWVAVIWYDGSNQYYADSVKGRFTISRDNSKNTLYLQMNSLRADDTAVYYCAKKGGGPYCGGDCSSGYFDLWGRGTLVTVSS

SEQ ID NO: 4980 - protein, 108 aa, Homo sapiens
DIQMTQSPSSLSASVGDRVTITCQASQDISNCLNWYQHKPGKAPELLIYDASNLEPGVPSRFSGSGSGTDFTFTISSLQPEDIATYYCQQYDNVPSITFGQGTRLEIK

SEQ ID NO: 4981 - protein, 128 aa, Homo sapiens
QVQLQQWGAGLLKPSETLSLTCAVYGESFSAYYWSWIRQPPGKGLEWIGEINHSGSTTYNPSLKSRVTISVDTSKNQFSLKLSSVTAADTAVYYCARKGRWARYSSGWYTYQYGLDVWGQGTTVTVSS

SEQ ID NO: 4982 - protein, 109 aa, Homo sapiens
EIVLTQSPGTLSLSPGEGATLSCRASQTVSSNYLAWYQQKPGQAPRLLIYGASSRATGIPDRFSGSGSGTDFTLTISRLEPEDFAVYYCQHYGRSPPFTFGPGTKVDIK

SEQ ID NO: 4983 - protein, 115 aa, Homo sapiens
EVQLVESGGGLIQPGGSLRLSCAASGLIVSRNYMYWVRQAPGKGLEWVSLIYSGGSTYYADSVKGRFTISRDNSKNTLYLQMNSLRAEDTAVYYCARGPYGESVWGQGTTVTVSS

SEQ ID NO: 4984 - protein, 107 aa, Homo sapiens
DIQMTQSPSSLSASVGDRVTITCQASQDINKYLNWYQQKPGKAPKLLIYDASNLETGVPSRFSGSGSGTDFSFTISSLQPEDIATYYCQQYDNLPLTFGGGTKVEIK

SEQ ID NO: 4985 - protein, 121 aa, Homo sapiens
QVQLVESGGGVVQPGRSLRLSCAASGFTFSIYAMHWVRQAPGKGLEWVAVISYDGSHKYYVDSVKGRFTISRDNSKNTLYLQMNSLRAEDTAVYYCARSGSGNYNNWFDPWGQGTLVTVSS

SEQ ID NO: 4986 - protein, 107 aa, Homo sapiens
EIVLTQSPGTLSLSPGERATLSCRASHSVSSSYLAWYQQKPGQAPRLLIYGASSRATGIPDRFSGSGSGTDFTLTISRLEPEDFAVYYCQQYGSGWTFGQGTKVEIK

SEQ ID NO: 4987 - protein, 128 aa, Homo sapiens
QVQLQESGPGLVKPSETLSLTCTVSGGSVTSGSYYWSWIRQPPGKGLEWIGYMYYSGSINYNPSLKSRVTTSVDTSKNQVSLKLRSVTAADTAVYYCARGQIHYYDSSGYRFPWFDPWGQGTLVTVSS

SEQ ID NO: 4988 - protein, 111 aa, Homo sapiens
QSVLTQPPSVSGAPGQRVTISCTGSSSNIGAGYDVHWYQQLPGTAPKLLIYGNNNRPSGVPDRFSGSKSGTSASLAITGLQAEDEADYYCQSYDSSLSGVVFGGGTKLTVL

SEQ ID NO: 4989 - protein, 122 aa, Homo sapiens
QVQLVESGGGVVQPGRSLRLSCAASGFTFSRYGMHWVRQAPGKGLEWVAVISHDGNNKYYADSVKGRFTISRDNSKNTLYLQMNSLRTDDTAVYYCAKDPSSMAAASGMDVWGQGTTVTVSS

SEQ ID NO: 4990 - protein, 106 aa, Homo sapiens
SFELTQPPSVSVSPGQTASITCSGDNLGSKYACWYQQKPGQSPVLVIYQDSQRPSGIPGRFSGSNSGNTATLTISGTQAIDEADYYCQAWDSSAVVFGGGTKLTVL

SEQ ID NO: 4991 - protein, 131 aa, Homo sapiens
ETQLLESGGGLGQPGGSLRLSCAASGFTFSTYAMSWVRQAPGKGLEWVSAISGSGGSIYYADSVKGRVTISRDNSKNTLYLQMDSLRAEDTAIYYCAKDQPHISMVQGAGERWWGYSFDYWGQGTLVTVSS

SEQ ID NO: 4992 - protein, 112 aa, Homo sapiens
QSALTQPASVSGSPGQSITISCTGTSSDVGSYNLVSWYQQHPGKAPKLMIYEGTKRPSGVSNRFSGSKSGNTASLTISGLQSEDEADYYCCSYAGSSTRPYVFGTGTKVTVL

SEQ ID NO: 4993 - protein, 121 aa, Homo sapiens
QVQLVESGGGVVQPGRSLRLSCAASGFTFSSYAMHWVRQAPGKGLEWVAVISYDGNNKYYADSVKGRFTISRDNSKNTLYLQMNSQRAEDTAVYYCARPHSGSYSSFIDYWGQGTLVTVSS

SEQ ID NO: 4994 - protein, 109 aa, Homo sapiens
EIVLTQSPGTLSLSPGERATLSCRASQSVSSSYLAWYQQKPGQAPRLLIYGASSRATGIPDRFIGSGSGTDFTLTINRLEPEDFAVYYCHQYDRSPRLTFGGGTKVEIK

SEQ ID NO: 4995 - protein, 121 aa, Homo sapiens
QVQLVESGGGVVQPGRSLRLPCAASGFTFNIYAMHWVRQAPGKGLEWVAVISYDGINKYYADAVKGRFTISRDNSKNTLYLQMNSLRPEDTAVYYCARSRGGNYYAGFDYWGQGTLVTVSS

SEQ ID NO: 4996 - protein, 111 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEATYYCSSYTSSSAPYVFGTGTKVTVL

SEQ ID NO: 4997 - protein, 121 aa, Homo sapiens
QVQLVESGGGVVQPGGSLTLSCAASGFTFSSYAMHWVRQAPGKGLEWVAVISYDGINEYYADSVNGRLTISRDNSKNTLYLQTNSLRAEDTAVYYCARSKSGSYFYGMDVWGQGTTVTVSS

SEQ ID NO: 4998 - protein, 107 aa, Homo sapiens
DIQMTQSPSTLSASVGDRVTITCRASQSISSWLAWYQQKPGKAPKLLIYKASTLESGVPSRFSGSGSGTEFTLTISSLQPDDFATYYCQQYNSYSWTFGQGTKVEIK

SEQ ID NO: 4999 - protein, 126 aa, Homo sapiens
QVQLVESGGGVVQPGRSLRLSCAASGFTFSSYPMHWVRQAPGKGLEWVTLISYDGSNKYYADSVKGRFTISRDNSRNTLYLQMNSLRAEDTAVYYCARDYVVMVVADYFHYGMDVWGQGTTVTVSS

SEQ ID NO: 5000 - protein, 116 aa, Homo sapiens
QAVLTQPSSLSASPGASASLTCTLRSGINVGTYRIYWYQQKPGSPPQFLLRYKSDSDYQRGSGVPSRFSGSKDASANAGILLISGLQTEDEADYYCMIWHSSASAVFGGGTKLTVL

SEQ ID NO: 5001 - protein, 112 aa, Homo sapiens
QVQLQESGPGLVKPSETLSLTCTVSGGSISSYYWSWIRQPPGKGLEFIGYIYYSGSTNYNPSLKSRVTISVDTSKNQFSLKLTSVTAADTAVYYCARGFDYWGQGTLVTVSS

SEQ ID NO: 5002 - protein, 108 aa, Homo sapiens
EIVLTQSPGTLSLSPGERATLSCRASQSISSIYLGWYQQKPGQAPRLLIYGASSRAIGIPDRFSGSGSGTDFTLTISRLEPEDFAVYYCQQYGSSPWTFGQGTKVEIK

SEQ ID NO: 5003 - protein, 124 aa, Homo sapiens
EVQLVQSAAEVKKPGTTLKISCKVSGYTFIDFYMHWVQQAPGKGLEWMGLVDPEDGETIYAEKFQGRVTITADTSSDTAYMELSSLRSEDTAVYYCATDTSLGMTTVTTDSRKWGQGTLVTVSS

SEQ ID NO: 5004 - protein, 112 aa, Homo sapiens
DIVMTQTPLSSPVTLGQPASISCRSSQSLVHSDGNTYLSWLQQRPGQPPRLLIYKVSNRFSGVPDRFSGSGAGTDFTLKISRVEVEDVGIYYCMQATQFPLTFGGGTKVEIK

SEQ ID NO: 5005 - protein, 123 aa, Homo sapiens
QVQLVQSGAEVKKPGASVKVSCKVSGYTLVELSIYWVRQAPGKGLEWMGGFDPDKGETIYAQKFQGRVTMTEDTSTDTAYMELSSLRSEDTAVYYCTATAPTSIAAKNWFDPWGQGTLVTVSS

SEQ ID NO: 5006 - protein, 110 aa, Homo sapiens
QSVLTQPPSVSAAPGQKVTISCSGSSSNIGNNYVSWYQQFPGTAPKLVIYDNNKRPSGIPDRFSGSKSGTSATLGITGLQTGDEADYYCGTWDSSLSAVVFGGGTKLTVL

SEQ ID NO: 5007 - protein, 122 aa, Homo sapiens
QVQLQESGPGLVKPSDTLSLTCTVSGYSISNSNWWGWIRQPPGKGLEWIGYIYYSESPYYNPSLMSRLTMSVDTSKNQFSLKLSSVTAVDTAVYYCARTQAYSSRFRAFDIWGQGTMVSVSS

SEQ ID NO: 5008 - protein, 106 aa, Homo sapiens
SYEVTQPRSVSVSPGQTASITCSGDKLGDKNSCWYQQKPGQSPVLVIYQETTRPSGIPERFSGSISGNTATLTISGTQAMDEADYYCQAWDSGIVVFGGGTKLTVL

SEQ ID NO: 5009 - protein, 121 aa, Homo sapiens
QVQLQQWGAGLLKPSETLSLTCAVYGGSFSNYYWTWIRQPPGKGLEWIGEINHSGSTNYNPSLKSRVTISVDTSKNHFSLKVNSVTAADTAVYFCARGWGSSTWYQIFDYWGQGIQVTVSS

SEQ ID NO: 5010 - protein, 110 aa, Homo sapiens
RSALTQPASVSGSPGQSITISCTGTSGDVGSYNLVSWYQQHPGKAPKLMIYEGLKRPSGVSDRFSGSKSGNTASLTISGLQAEDEADYYCYSYAGSSTWVFGGGTKLTVL

SEQ ID NO: 5011 - protein, 119 aa, Homo sapiens
EVQLLESGGGLVQPGGSLRLSCAASGFIFSGYAMSWVRQAPGKGLEWVSAISGSSSAIYYTDSVRGRFTISRDNSKNTLYLQMNSLRAEDTAVYYCAKDPNGVLYFDYWGQGALVTVSS

SEQ ID NO: 5012 - protein, 106 aa, Homo sapiens
DIQMTQSPSTLSASVGDRVTITCRASQSISSWLAWYQQKPGKAPNLLIYEASSLESGVPSRFSGSGSGTEFTLTISSLQPDDFATYYCQQYSTYSTFGQGTRLEIK

SEQ ID NO: 5013 - protein, 127 aa, Homo sapiens
QLQLQESGPGLVKPSETLSLTCTVSGGSISSSRHYWGWIRQAPGKGLEWIGSMFYSASTYYNPSLQSRVSIFEDTSKNQFSLKLSSVTAADTAVYYCARLEFGLLWFGEFSDASDIWGQGTMVTVSS

SEQ ID NO: 5014 - protein, 107 aa, Homo sapiens; identical to SEQ ID NO: 858

SEQ ID NO: 5015 - protein, 122 aa, Homo sapiens
QVQLVQSGSELKKPGASVKVSCQASGYTFTNHAMNWVRQAPGQGLEWMGWINTNTGNPTYAQGFTGRFVFSLDTSVTTAYLQITSLKAEDTAFYYCARASARPGVATNFDFWGQGTLVVVSS

SEQ ID NO: 5016 - protein, 107 aa, Homo sapiens
DIQMTQSPSSLSASVGDRVTITCRASQSIDNYLNWYQQKPGKAPNLLIYAASSLHSGVPSRFSGSGSGTDFTLIISSLQPEDLATYYCQQSYSNPLTFGPGTKVDIR

SEQ ID NO: 5017 - protein, 126 aa, Homo sapiens
QVQLQESGPGLVKPSQTLSLTCTVSGGSISSGDYYWSWIRQPPGKGLEWIGYIYYSGFTYYNPSLKSRVTISVDTSKNQFSLKLSSVTAADTAVYYCAREHLVQGTSPPYFGFDYWGQGTLVTVSS

SEQ ID NO: 5018 - protein, 107 aa, Homo sapiens
EIVMTQSPATLSVSPGERATLSCRASQSVNSNLAWYQQKPGQAPRLLIYGASTRATGIPARFSGSGSGTEFTLIISSLQSEDFAVYYCQQYNNWPRTFGQGTKVEIK

SEQ ID NO: 5019 - protein, 126 aa, Homo sapiens
EVRLMEFGGGLVQPGGSLRLSCAASGFTFSYYNMNWVRQAPGKGLEWISYISSSSNTINYADSVKGRFTISRDNGKNSLYLQMNSLRDEDTGVYYCARDSYEVLTGFNSIPPFDYWGQGALVTVSS

SEQ ID NO: 5020 - protein, 107 aa, Homo sapiens
DIQMTQSPSSLSAFVGDRVTITCRASQGIRNDLGWYQQKPGKAPKRLIYAASSLQSGVPSRFSGSGSGTEFTLTISSLQPEDFATYYCLQYNSYPITFGQGTRLEIK

SEQ ID NO: 5021 - protein, 121 aa, Homo sapiens
QVQLVESGGGVVQPGRSLRLSCAASGFTFSTYAMHWVRQAPGKGLEWVAVISYDGINKYYADSVKGRFTISRDNSKNTLYLQMNSLRSEDTAVYYCARALGGGYYHGMDVWGQGTTVTVSS

SEQ ID NO: 5022 - protein, 111 aa, Homo sapiens
QSALTQPASVSGSPGQSITISCTGTSSDVGDYNYVSWYQQHPGKAPKLMIYDVSNRPSGVSNRFSGSKSANTASLTISGLQAEDEADYYCTSYTSSSTLYVFGTGTKVTVL

SEQ ID NO: 5023 - protein, 122 aa, Homo sapiens
QVQLVESGGGVVQPGKSLRLSCAGSGFTFSSYAMHWVRQAPGKGLEWVAVISYDGSNKYYAYSVKGRFTISRDNSKNTLYLHMNSLRAEDTAVYYCARGYHSGSYYPLYLYWGQGTLVTVSS

SEQ ID NO: 5024 - protein, 106 aa, Homo sapiens
DIQMTQSPSTLSASVGDRVTITCRASQSISNWLAWYQQKPGKAPKLLIYEASSLQSGVPSRFSGSGSGTEFTLTISSLQPDDFATYFCQHYNTYSTFGQGTKLEIK

SEQ ID NO: 5025 - protein, 124 aa, Homo sapiens
EVQLVESGGGLVQPGGSLRLSCAASGFTFSSHSMNWVRQAPGKGLVWVSYISTSSSTIYYADSVKGRFTISRDNAKNSLYLQMNSLRAEDTAVYYCARERSGDYGPYYYGMDVWGQGTTVSVSS

SEQ ID NO: 5026 - protein, 107 aa, Homo sapiens
DIQMTQSPSSLSASVGDRVTITCRASQSISSYLNWYHQKPGKAPKLLIYAASSLQSGVPSRFSGSGSGTDFTLTISSLQPEDFATYYCQQSYSTPRTFGQGTKVEIK

SEQ ID NO: 5027 - protein, 121 aa, Homo sapiens
QVQLVESGGGVVQPGRSLRLSCAASGFTFSIYAMHWVRQAPGKGLEWLALISYDGSNKYFADAVRGRFTISRDNSKNTLYLLMNSLRAEDTAVYYCARALGGTYSHPFDYWGQGSLVTVSS

SEQ ID NO: 5028 - protein, 107 aa, Homo sapiens
EIVLTQSPGTLSLSPGERATLSCRASQSVSSSYLAWYQQKPGQAPRLLIYGASSRATGIPDRFSGSGSGTDFTLTISRLAPEDFAVYYCQQYGSLYTFGLGTELEIR

SEQ ID NO: 5029 - protein, 123 aa, Homo sapiens
QVQLVQSGAEVKKPGASVKVSCKASGYTFTAYYMHWVRQAPGQGLEWMGWINPNSDDTNYAQKFQGRVTMTRDTSISTAYMELSRLRSDDTAVYYCAREEGVFTIGDRYFDLWGRGTLVSVSS

SEQ ID NO: 5030 - protein, 110 aa, Homo sapiens
QTVVTQEPSFSVSPGGTVTLTCGLSSGSVSTSYYPSWYQQTPGQAPRTLIYNTNTRSSGVPDRFSGSILGNKAALTITGAQADDESDYYCVLYMGSGIWVFGGGTKLTVL

SEQ ID NO: 5031 - protein, 125 aa, Homo sapiens
EVQLLESGGGLVQPGGSLRLSCAASGFTFSNYAMSWVRQAPGKGLEWVSGISGGGGSTYDADSVKGRFTISRDNSKNTLYLQMNSLRAEDTAVYYCAKGDYISSWYVPPYDMDVWGQGTTVTVSS

SEQ ID NO: 5032 - protein, 112 aa, Homo sapiens
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPPTFGGGTKVEIK

SEQ ID NO: 5033 - protein, 123 aa, Homo sapiens
EVQLLESGGGLVQPGGSLRLSCAASGFTFSNYAMNWVRQAPGKGLEWVSAISGSGGGTYYADSVKGRFTIFRDNSKNTLYLQMISVRADDTAIYYCAQIPPPRMAAAAIVYYWGQGTLVTVSS

SEQ ID NO: 5034 - protein, 110 aa, Homo sapiens
QSVLTQPPSASGTPGQRVTISCSGSSSNIGSNTVNWYQQLPGTAPKLLIYSSNQRPSGVPDRFSGSKSGTSASLAISGLQSVDEADYYCAAWDDSLTGYVFGTGTTVTVL

SEQ ID NO: 5035 - protein, 125 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCATEGITMLRAVGYGLDVWGQGTTVTVSS

SEQ ID NO: 5036 - protein, 110 aa, Homo sapiens
QSALTQPASVSGSPGQSITISCTGTSSDVGRYNSVSWYQQHPDKAPKLIIYEVTNRPSGVSNRFSGSKSGNTASLTISGLQAEDEADYFCSSFTTISTLVFGTGTKVTAL

SEQ ID NO: 5037 - protein, 120 aa, Homo sapiens
QVQLVESGGGVVQPGKSLRLSCAASGFTFGSYAIHWVRQAPGKGLEWVAVISHDGSKKYYADSVKGRFTISRDKSKNTLYLQMNSLRAEDTAVYHCARDSESVAGPLDYWGQGTLVTVSS

SEQ ID NO: 5038 - protein, 106 aa, Homo sapiens
SYELTQPPSVSVSPGQTASITCSGGKLDYKYAYWYQQKPGQSPVLVIYQDTKRPSGIPERFSGSSSGNTATLTISETQAMDEADYYCQAWDSNTVVFGGGTKVTVL

SEQ ID NO: 5039 - protein, 123 aa, Homo sapiens
QVQLVESGGGVVQPGRSLRLSCAASGFTFSSYAMHWVRQAPGKGLEWVAVVSYDGNYKNYADSVKGRLTISRDNSKNTLYLQMNSLRLEDTAVYYCARDSITMVRGNSWFDPWGQGTLVTVSS

SEQ ID NO: 5040 - protein, 108 aa, Homo sapiens
EIVLTQSPATLSLSPGERATLSCGASQSVTSNYLAWYQQKPGLAPRLLIYDASSRATGIPDRFSGSGSGTDFTLTISRLEPEDFAVYYCQQYGSSPLTFGGGTKVEIK

SEQ ID NO: 5041 - protein, 124 aa, Homo sapiens
QVQLVESGGGVVQPGRSLRLSCAASGFTFSSYAMHWVRQAPGKGLEWVAVISYDVSNKYYADSVKGRFTISRDNSKNTLYLQMNSLRVEDTAVYYCAKAGGGYSSSWLGIFGYWGQGTLVTVSS

SEQ ID NO: 5042 - protein, 114 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPPLFTFGPGTKVDIK

SEQ ID NO: 5043 - protein, 121 aa, Homo sapiens
QVHLVQSGGGVVQPGKSLTISCAASGFDFRTYGMHWVRQAPGKGLEWVANVWIDGTNTYYADSVRGRFTISRDDSKSILSLQMDSLTGDDTAVYYCARADWPGHGAGVDVWGQGTTVIVSA

SEQ ID NO: 5044 - protein, 107 aa, Homo sapiens
DIQMTQSPSSLSASIGDRVTITCRASRPINTYLAWYQQRPGKVPKLLINGASTLQSGVPSRFRGSGSGTDFTLTISSLQPEDVATYYCQRYNGPPFAFGPGTKVDLK

SEQ ID NO: 5045 - protein, 119 aa, Homo sapiens
QVQLQQWGAGLLKPSETLSLTCAVYGVSFRGYYWSWIRQPPGKGLEWIGEINHSGSTNYNPSLKSRVTISVDTSKNQVSLKLSSVTAADTAVFYCARGGGYSYGAIDYWGQGTLVTVSS

SEQ ID NO: 5046 - protein, 111 aa, Homo sapiens
QSVLTQPASASGTPGQRVTISCSGSSSNIGINYVYWYQQLPGTAPKLLIYRNNQRPSGVPDRFSGSKSGTSASLAVSGLRSEDEADYYCAAWDDSLSGHVVFGGGTKLTVL

SEQ ID NO: 5047 - protein, 120 aa, Homo sapiens
QVQLQESGPGLVKPSQTLSLTCTVSGGSISSGAYYWNWIRQHPGKGLEWIGNIYYSGGTYYKPSLKSRVTISVDTSKNQFSLKLSSVTAADTAVYYCARQMWLRGAFDIWGQGTMVTVSS

SEQ ID NO: 5048 - protein, 110 aa, Homo sapiens
NFMLTQPHSVSESPGKTVTISCTGSSGSIASNYVQWYQQRPGSAPTTVIYEDNQRPSGVPDRFSGSIDSSSNSASLTISGLKTEDEADYYCQSYDSSNVLFGGGTKLTVL

SEQ ID NO: 5049 - protein, 124 aa, Homo sapiens
EVQLVESGGGLVQPGGSLRLSCAASGFTFSTYSMNWVRQAPGKGLEWVSYISKSSSTKYDADSVKGRFTISRDDAKNTLYLQMDSLRDEDTAVYYCARHHGSGLSYYYYGLDVWGQGTTVTVSS

SEQ ID NO: 5050 - protein, 107 aa, Homo sapiens
DIQMTQSPSSLSASVGDRVTITCRASQNIYSYLSWYQQKPGKAPKLLIYAASSLQSGVPSRFSGSGSGTDFTLTISSLQPEDFATYYCQQSYSTPPTFAQGTKVEIK

SEQ ID NO: 5051 - protein, 119 aa, Homo sapiens
EVQLLESGGGLVQPGGSLRLSCAASGFTFSSYAMTWVRQAPGKGLEWVSAISATGGSTFYADSVKGRFTISRDNSKNTLYLQMNSLRAEDTAVYYCAKPYYGSGAFDIWGQGTMVTVSS

SEQ ID NO: 5052 - protein, 115 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPMYTFGQGTKLEIK

SEQ ID NO: 5053 - protein, 131 aa, Homo sapiens
EEQLVESGGGLVQPGGSLRLSCAASGFTFSHYWMTWVRQAPGKGLKWVANIREDGSEKHYVDSVKGRFTISRDNAKNLVYLQMNTLRAEDTAVYYCARERVLLGQCSGDNCYTKRNWFDPWGPGTLVTVSS

SEQ ID NO: 5054 - protein, 110 aa, Homo sapiens
EIVLTQSPATLSLSPGEGATLSCRASQSVSSYLAWYQHKPGQAPRLLIYDASNRATGIPPRFSGSGSGTDFTLTISSLEPEDFAVYYCQQRSNWPPEGLTFGGGTKVEVK

SEQ ID NO: 5055 - protein, 122 aa, Homo sapiens
QVQLVQSGAEVKKPGASVTVSCKASGYTFTNYYMHWVRQAPGQGLEWMGIINPSGGSTGYAQKFQGRVTMTGDTSTSTVYMELRSLRYEDTAVYYCARDGALIPAGAPVDYWGQGTLVTVSS

SEQ ID NO: 5056 - protein, 111 aa, Homo sapiens
QSALTQPASVSGSPGQSITISCTGTSSDVGDYNYVSWYQQHPGKAPKLMIYDVRHRPSGVSNRFSGSKSGNTASLTISGLQAEDEADYYCSSKRSSTTLYVFGTGTKVTVL

SEQ ID NO: 5057 - protein, 126 aa, Homo sapiens
EVQLVQSGAEVKKPGESLKISCKGSGYSFTNYWIGWVRQMPGKGLEWMGIIYPGDSDTRYNPSFQGQVTISADRSISAAYLQWSSLKASDTAIYYCARQNWYYYGSGTKYPGLDVWGQGTTVTVSS

SEQ ID NO: 5058 - protein, 107 aa, Homo sapiens
EIVLTQSPVTLSLSPGERATLSCRASQSVSYRYLAWYQQKPGQAPRLLIYGASSRATGIPDRFSGSGSGTDFTLTISRLEPEDFAVYYCQQYGSSPRFGRGTKVEIK

SEQ ID NO: 5059 - protein, 118 aa, Homo sapiens
QVQLQESGPGLVKPSETLSLTCTVSGGSISSYYWSWIRQSPGKVLEWIGYITYSGSTNYNPSLKRRVTISVDTSKNQFSLKLRSVTVADTAVYYCTGGEYQPYQIDNWGQGTLVTVSS

SEQ ID NO: 5060 - protein, 106 aa, Homo sapiens
SYELTQPPSVSVSPGQTASITCSGDKLENKYACWYQQKPGQSPVLVIYQDNKRPSGIPERFSGSNSGNTATLTISGTQAMDEADYYCQAWDSNTVIFGGGTKLTVL

SEQ ID NO: 5061 - protein, 120 aa, Homo sapiens
QVQLVESGGGVVQPGRSLRLSCAASGFTFSTYAMHWFRQAPGKGLDWVAVISYDGSNKYYADSVKGRFTISRDNSKNTVYLQMNSLRAEDTAVYYCARDQGVMKYGMDVWGQGTTVTVSS

SEQ ID NO: 5062 - protein, 108 aa, Homo sapiens
DIQLTQSPSFLSASVGDRVTITCRASQGISSYLAWYQQKPGKAPKLLIYAASTLQSGVPSRFSGSGSGTEFTLTIDSLQPEDFATYYCQQLNSSPLFTFGPGTKVDIK

SEQ ID NO: 5063 - protein, 127 aa, Homo sapiens
QVQLQESGPGLVKPSQTLSLTCTVSGGSISSGSYYWSWIRQPAGKGLEWIGRIYTSGSTNYNPSLKSRVTISVDTSKNQFSLKLSSVTAADTAVYYCAREEYCSGDSCSRANWFDPWGQGTLVTVSS

SEQ ID NO: 5064 - protein, 111 aa, Homo sapiens
QSVLTQPPSMSGAPGQRVTISCTGSSSNLGAGYHVHWYQQLPGTAPKLLIYSNNNRPSGVPDRFSGSKSGTSASLAITGLQAEDEADYYCQSYDSSLSDVLFGGGTKLTVL

SEQ ID NO: 5065 - protein, 129 aa, Homo sapiens
QVQLVQSGAEVKKSGASVKVSCKASGYTFSGYAIHWVRQAPGQRLEWMGWINAGNGNTKYSQKFQGRVTITRDTSANTAYMELSSLRSEDTAVYFCARGEWVGIYCDGDCFELAWFDPWGQGTLVTVSS

SEQ ID NO: 5066 - protein, 108 aa, Homo sapiens
EIVMTQSPATLSVSPGERATLSCRASRSVSSNLAWYQQKPGQAPRLLIYGASTRATGIPARFSGSGSGTEFTLTISSLQSEDFAVYYCQQYNNWPPLTFGGGTKVEIK

SEQ ID NO: 5067 - protein, 120 aa, Homo sapiens
QVQLVESGGGVVQPGRSLRLSCAASGFTFSSYAMHWVRQAPGKGLEWVAVISFDGSNKYNADSVKGRFTISRDNSKKTLYLQMNRLRAEDTGVYYCARDPNAVTGPLDYWGQGTLVTVSS

SEQ ID NO: 5068 - protein, 106 aa, Homo sapiens
SYELTQPPSVSVSPGQTASITCSGDKLGDKYASWYQQKPGQSPVLVIYQDIKRPSGIPERFSGSNSGNTATLTISGTQAMDEADYYCQAWASSTAVFGGGTKLTVL

SEQ ID NO: 5069 - protein, 122 aa, Homo sapiens
EVQLVESGGVVVQPGGSLRLSCAASGFTFDDYTMHWVRQAPGKGLEWVSLISWDGDRSYYADSVKGRFTISRDNSRNSLYLQMNSLRTEDTALYYCAKADSRSWYTDAFDVWGRGTMVTVSS

SEQ ID NO: 5070 - protein, 110 aa, Homo sapiens
QSVLTQPPSASGTPGQRVTISCSGSSSNIGNNPVNWYQQLPGTAPKLLIYNNNQRPSGVPDRFSGSQSGTSASLAISGLQSEDEAEYYCAAWDDSLNGRVFGGGTKLTVL

SEQ ID NO: 5071 - protein, 129 aa, Homo sapiens
EVQLVESGGGLVQPGGSLRLSCAASRFTFSSYWMSWVRQAPGKGLEWVANIKQDGSEKYYVDSVKGRFTISRDNAKNSLYLQMNSLRAEDTAVYYCARVRVYYASGSYSYYYYYTMDVWGQGTTVTVSS

SEQ ID NO: 5072 - protein, 110 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPRFTFGPGTKVDIK

SEQ ID NO: 5073 - protein, 128 aa, Homo sapiens
QDQLVQSGAEVKKPGSSVKVSCKASGGTFSSYAISWVRQAPGQGLEWMGRIIPILDVANYAQKFQGRVAITADKSTSTAYMELSSLRSEDTAVYYCARPILDYGDYIRDWGQYGMDVWGQGTTVTVSS

SEQ ID NO: 5074 - protein, 112 aa, Homo sapiens
DIVMTQSPLSLPVTPGEPASISCRSSQSLLHSNGYNHLDWYLQKPGQSPQLLIYLSSKRASGVPARFSGSGSGTDFTLKISRVEAEDVGVYYCMQALQTPLTFGGGTKVEIK

SEQ ID NO: 5075 - protein, 121 aa, Homo sapiens
QVQLVESGGGVVQPGRSLRLSCAASGFTFSTYGMHWVRQAPGKGLEWVAVIWYDGSNKHYKDSVKGRFTISRDNSKNTLYLQLNSLRAEDTAVYYCAKDRGSGWYGYFDEWGQGTLVTVSS

SEQ ID NO: 5076 - protein, 109 aa, Homo sapiens
EIVLTQSPGTLSLSPGERATLSCRASQRVGSSYIAWYQQKPGQAPRLLIYGASSRATGIPDRFSGSGSGTDFTLTISRLEPEDFAVYYCQQYGASPLYTFGQGTKLEIK

SEQ ID NO: 5077 - protein, 125 aa, Homo sapiens
EVQLLESGGGLVQPGESLRLSCAASAFIFRSYAMSWVRQAPGKGLEWVSVISGSGGRITYADSVKGRFTISRDNSKNTLYLQMNSLRAEDTAVYYCAKSFFMTTVTTGDGSFDYWGQGTLVTVSS

SEQ ID NO: 5078 - protein, 110 aa, Homo sapiens
QSALTQPASVSGSPGQSITISCTGTSSDVGGYNYVSWYQHHPDKAPKLMIYELSNRPSGVSSRFSGSKSGNTASLTISGLQAEDEADYYCSSYTSSSTYVFGTGTKVTVL

SEQ ID NO: 5079 - protein, 112 aa, Homo sapiens
QVQLQESGPGLVKPSETLSLTCTVSGGSISNYYWSWIRQSPGKGLEWIGYIYYSGSTNYNPSLKSRVTISVDTSKNQFSLKLNSVTAADTAIYYCARGFDYWGQGTLVTVSS

SEQ ID NO: 5080 - protein, 108 aa, Homo sapiens
EIVLTQSPGTLSLSPGERATLSCRASQSVSSSYLAWYQQKPGQAPRLLMFAASSRAIGIPDRFSGSGSGTDFTLTISRLEPEDFAVYYCQQYGNSPWTFGQGTKVEIK

SEQ ID NO: 5081 - protein, 118 aa, Homo sapiens
QVQLQESGPGLVKPSETLSLTCTVSNDSISSYYWSWIRQPAGKGLEWIGRVFVSGSTDYNPSLKSRVTMSVDTSKNQFSLKLRSVTAADTAVYYCARDSGGWHVFDYWGQGTLVTVSS

SEQ ID NO: 5082 - protein, 106 aa, Homo sapiens
SYELTQPPSVSVSPGQTASITCSGDKLENKYASWYHQKPGQSPVLVMYQDTKRPSGIPERFSGSSSGNTATLTISGTQVMDEAEYYCQAWGSNTVVFGGGTKLTVL

SEQ ID NO: 5083 - protein, 123 aa, Homo sapiens
QLQLQESGPGLVKPSETLSLTCTVSGGSISSINYYWGWIRQPPGKGLEWIGSIYYSGITYYNPSLESRVTIFVDTSKNQFSLKLSSVTAADTAVYYCARVIDTFYYSDVLDVWGQGTTVTVSS

SEQ ID NO: 5084 - protein, 107 aa, Homo sapiens
DIQMTQSPSFLSASVGDRVTITCRASQGIRNDLGWYQQKPGKVFKRLIYAASTLQSGVPSRFSGSGSGTQFTLTISSLQPEDFATYYCLQHNSYPLTFGGGTKVEIK

SEQ ID NO: 5085 - protein, 126 aa, Homo sapiens
EVQLVESGGGLVQRGGSLKLSCAASGFIFSGSAMHWVRQASGKGLEWVGRIRIKADNYATAYAASVKGRFTISRDDSRTTAYLQMNSLKTEDTAVYYCCSAMGIRAAAMNWYFDLWGRGTLVTVSS

SEQ ID NO: 5086 - protein, 107 aa, Homo sapiens
DIQMTQSPSSLSASVGDRVTITCRAGQSISSYLNWYQQKPGKAPKLLIYIASSLQSGVPSRFSGSGSGTDFTLTISSLQPEDFATYYCQQSYSTPPTFGQGTKLEIK

SEQ ID NO: 5087 - protein, 124 aa, Homo sapiens
QVQLQESGPGLVKPSQTLSLTCSVSGGSISSGGYYWSWIRQHPGKGLEWIGYISYSGSTYYNPSLKSRVTMSVDTSKNQFSLKLSSVTAADTAVYYCARFNYGVLTGRQQFDLWGRGTLVTVSS

SEQ ID NO: 5088 - protein, 111 aa, Homo sapiens
QSVLTQPPSLSAAPGQNVTISCSGSSSNIGKNYVSWYQQVPGTAPKLLIYDNKKRPSGIPDRFSGSKSGTSATLGITGLQTGDEADYYCGTWDARLDAFWVFGGGTKLTVL

SEQ ID NO: 5089 - protein, 127 aa, Homo sapiens
HLQLQESGPGLLKPSETLSLTCTVSGGSIRSSSYYWGWIRQPPGKGLEWIGSIYYSGSTYYNPSLKSRVTVSVDTPKNQFSLKLRSLTAADTAVYYCAGESLRFLERPLSAYGMDVWGQGTTVTVSS

SEQ ID NO: 5090 - protein, 110 aa, Homo sapiens
QSALTQPASVSGSPGQSITISCTGTSSDVGGYNYVSWYQQHPGKAPKLLIYDVTSRPSGVSNRFSGSKSGNTASLTISGLQAEDAADYYCSSFTSISTVVFGGGTKLTVL

SEQ ID NO: 5091 - protein, 120 aa, Homo sapiens
QVQLVESGGGVVQPGRSLRLSCAASGFTFSGYGMHWVRQAPGKGLEWVAVISYDGSYKYYADSVKGRFTISRDNSKNTLYLQMNSLRAEDTAVYYCAKDYGDYVTWFDPWGQGTLVTVSS

SEQ ID NO: 5092 - protein, 108 aa, Homo sapiens
DIQMTQSPSSLSASVGDRVTITCRASQSISTYLNWYQQKPGKAPKLLIYAASSLQSGVPSRFSGSGSGTDFTLTISSLQPGDFATYFCQQSYSTPPWTFGQGTKVEVK

SEQ ID NO: 5093 - protein, 128 aa, Homo sapiens
QVTLKESGPVLVKPTETLTLTCTVSGFSLINARMGVSWIRQPPGKALEWLAHILSSDEKSYSTSLKSRLTISKDTSKSQVVLTMTNMDPVDTATYYCARNHYSSSPYRGPFDWYFDLWGRGTLVTVSS

SEQ ID NO: 5094 - protein, 107 aa, Homo sapiens
SYVLTQPPSVSVAPGKTARITCGGNNIGSKSVHWYQQKPAQAPVLVINYDNDRPSGIPERFSGSKSGNTATLTISRVEAGDEADYYCQVWDRSSDHVFGTGTKVTVL

SEQ ID NO: 5095 - protein, 120 aa, Homo sapiens
QVQLVESGGGVVQPGRSLRLSCAASGFNLSNYAMHWVRQASGKGLEWVSLISYDGRIKYYTDSVKGRFTVSGDNSKNTLFLQMNSLRADDSALYYCVRGGVSGPNSFDMWGQGTTVTVSS

SEQ ID NO: 5096 - protein, 112 aa, Homo sapiens
DVVMTQSPLSLPVTLGQPASISCKSSQGLVYSDGNTYVNWFQQRPGQSPRRLIYQVSIRASGVPDRFSGSGSGTDFALKISRVEAEDVGLYYCMQGTHWPVTFGQGTKVEIK

SEQ ID NO: 5097 - protein, 118 aa, Homo sapiens
QVHLVESGGGVVQPGKSLRLSCAASGFIFSSFGMHWVRQPPGKGLEWVGVVSYGGSVTKYSDSFEGRFTISRDNSKNYLYLQMDSLRPEDTAVYFCAKGQGANLLQDWGQGILVTVSS

SEQ ID NO: 5098 - protein, 112 aa, Homo sapiens
DVVLTQSPLSLPVTLGQPASISCRSSESLVYTDGDTYLHWFHQRPGQSPRRLIHNVSNRDSGVPDRFSGSGSGTDFTLKISRVEAEDVGVYYCMQGTHWPFTFGPGTKVDIK

SEQ ID NO: 5099 - protein, 122 aa, Homo sapiens
EVQLLESGGGLGQPGGSLRLSCAASGFTFNSYAMSWVRQAPGKGLEWVSAISSTGGTTFYADSVKGRFTLSRDNSKNTLSLQMTSLRAEDTAVYYCAKSGARIAAAGTFDYWGQGNLVTVSS

SEQ ID NO: 5100 - protein, 109 aa, Homo sapiens
EIVLTQSPGTLSLSPGERATLSCRASQSVSSTYLAWYQQKPGQAPRLLIYGASYRATGIPDRFSGSGSGTDFTLTISRLEAEDFAVYYCQHYGSSPIYTFGQGTKLEIK

SEQ ID NO: 5101 - protein, 128 aa, Homo sapiens
QLQLQESGPGLLKPSETLSLTCSVSGGSISSDSYYWGWIRQPPGKGLEWIGTIYYTRSTSYNPSLKSRVTISVDTSKNQFSLKMSSVTAADTAVYYCARPTTFYFYPSGISHTWFDPWGQGTLVTVSS

SEQ ID NO: 5102 - protein, 112 aa, Homo sapiens
QSVLTQPPSVSGAPGQRVTISCTGSSSNIGAGSDVHWYQQLPGTAPKVLIYANNNRPSGVPDRFSGSKSGTSASLAITGLQAEDEADYYCQSYDSSLSGSKVFGTGTKVTVL

SEQ ID NO: 5103 - protein, 127 aa, Homo sapiens
QVQLVESGGGVVQPGRSLRLSCAASGFIFSAYGMHWVRQAPGKGLEWVAVISYDGSNKYYTDSVKGRFTISRDNSKNTLYLQMNSLRAEDTAIYYCAKEALGYCSSSSCYGKRFDPWGQGTLVTVSS

SEQ ID NO: 5104 - protein, 113 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQIPPFTFGGGTKVEIK

SEQ ID NO: 5105 - protein, 128 aa, Homo sapiens
EVQLLESGGGLVQPGGSLRLSCAASGFTFRSYVMSWVRQAPGKGLEWVSAVSKNGGSTYFADSVKGRFTISRDNSKNTLYLQMNSLRAEDTAVYYCAKDGPYASGRMDFYYYYAMDVWGQGTTVTVSS

SEQ ID NO: 5106 - protein, 112 aa, Homo sapiens
QSALTQPASVSGSPGQSITISCTGTSSNVGSYNLVSWYQQHPGKAPKLMIYEGSKRPSGVSNRFSGSKSGNTASLTISGLQAEDEADYYCCSYAGSSTSFVVFGGGTKLTVL

SEQ ID NO: 5107 - protein, 120 aa, Homo sapiens
QVQLVESGGGVVQPGRSLRLSCAASGFNLSNYAMHWVRQASGKGLEWVSLISYDGSIKYYRDSVKGRFTVSGDNSKNTLFLQMNSLRPDDSALYYCVRGGVSGPNSFDMWGQGTTVTVSS

SEQ ID NO: 5108 - protein, 112 aa, Homo sapiens
DVVMTQSPLSLPVTLGQPASISCRSSQSLVYSDGNTYVNWFQQRPGQSPRRLIYQVSIRASGVPDRFSGSGSGTDFALKLSRVEAEDVGIYYCMQGTHWPVTFGQGTKVEIK

SEQ ID NO: 5109 - protein, 112 aa, Homo sapiens
QVQLQESGPGLVKPSETLSLTCSVSGGSISSYYWSWIRQPPGKGLEWIGYIYDSGSTNYNPSLKSRVTISVDTSKNQFSLKLSSVTAADTAVYYCARGFDPWGQGTLVTVSS

SEQ ID NO: 5110 - protein, 108 aa, Homo sapiens
DIVLTQSPGTLSLSPGERATLSCRASQSVSSIYLAWYQQKPGQAPRLLIYAASSRAIGIPDRFSGSGSGTEFTLTISRLEPEDFAVYYCQQYGSSPWTFGQGTKVEIK

SEQ ID NO: 5111 - protein, 122 aa, Homo sapiens
EVQLLESGGGLVQPGGSLRLSCAASGFTFNSYAMNWVRQAPGKGLEWVSVLYSGGSSTYYADSVKGRFTISRDKSKNTLFLQMNSLRAEDTAVYYCANANLVAGQYNGMDVWGQGTTVTVSS

SEQ ID NO: 5112 - protein, 107 aa, Homo sapiens
DIQMTQSPSTLSASVGDRVTITCRASQSISSWLAWYQQKPGKAPKLLIYKASSLQSGVPSRFSGSGSGTEFTLTISSLQPDDFASYYCQHYSSYSWTFGQGTKVEIK

SEQ ID NO: 5113 - protein, 125 aa, Homo sapiens
QVQLQESGPGLVKPSGTLSLTCGVSGASISTTNWWSWVRQPPGKGLEWIGEIYHSGSTNYNPSLKSRVTISVDKSRNQFSLKLSSVTAADTAVYYCARVRWFREPGPYHYGMDVWGQGTTVTVSS

SEQ ID NO: 5114 - protein, 109 aa, Homo sapiens
EIVLTQSPATLSLSPGERATLSCRASQSVSSYFAWYQQKPGQAPRLLIYDTSNRATGIPARFSGSGSGTDFTLTISSLEPEDFAVYYCQQRSNWPPRFTFGPGTKVDIK

SEQ ID NO: 5115 - protein, 122 aa, Homo sapiens
EVQLVESGEKMTRPGGSLRLSCAASGFTFGDYGMSWVRQAPGKGLEWVSGINWNGDSTGYADSVKGRFTISRDNAKNSLYLQMNSLRAEDTALYYCARVGGYNSAWDAFDYWGQGTLVTVSS

SEQ ID NO: 5116 - protein, 111 aa, Homo sapiens
QLVLTQSPSASASLGASVKLTCTLSSGHSRFPIAWHQQQPEKGPRYLMRLNSDGSHSKGDGIPHRFSGSSSGAERYLTISSLQSEDAADYYCQTWGIGIQVFGGGTKLTVL

SEQ ID NO: 5117 - protein, 129 aa, Homo sapiens
EVQLVESGGGLVKPGGSLRLSCAASGFTFSYAWMSWVRQAPGKGLEWVGRIKSRTDGGTTDCAAPVKGRFTISRDDSKNTLYLQMNSLKTEDTAVYYCTTPRDYYGSGIYAYYNGMDVWGQGTTVTVSS

SEQ ID NO: 5118 - protein, 106 aa, Homo sapiens
SYELTQPSSVSVSPGQTARITCSGDVVTKKYVRWFQQKPGQAPVLVIYRDSERPSGIPERFSGSSSGTTVTLTISGAQVEDEADYYCYSAADKYPVFGGGTKLTVL

SEQ ID NO: 5119 - protein, 120 aa, Homo sapiens
QVHLVESGGGVVQPGRSLRLSCAASGFTFSSYAIHWVRQAPGKGLEWVAVISYDGINKYYGDSVKGRFTSSRDNSKNTLYLQMNSLRAEDTAVYYCARGRGNYQTYFDYWGQGTLVTVSS

SEQ ID NO: 5120 - protein, 109 aa, Homo sapiens
EIVLTQSPGTLSLSPGERATLSCRASQSVSSNYLAWYQQKPGQAPRLLIYAASSRATGIPDRFSGSGSGTDFTLTISRLEPEDFAMYYCQQYGRSPPMTFGPGTKVDIK

SEQ ID NO: 5121 - protein, 124 aa, Homo sapiens
QVQLVQSGAEVKKPGASVKVSCKASGYSSTSYGISWVRQAPGQGLEWMGWISAYNGNTNYVQKFQGRVTMTTDTSTNTAYMEVRSLRSDDTAVYYCARDRSTSGWYGGYYFDYWGQGTLVTVSS

SEQ ID NO: 5122 - protein, 110 aa, Homo sapiens
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDRSLSAWVFGGGTKLTVL

SEQ ID NO: 5123 - protein, 118 aa, Homo sapiens
EVQLVESGGGLIQPGGSLRLSCAASGFTVSSNYMSWVRQTPGKGLEWVSIIYSGGRTYYRDSVKGRFTISRDNSKNTLSLQMNSLRVEDTAVYYCAAIVEPTRWFDFWGQGTLVTVSS

SEQ ID NO: 5124 - protein, 108 aa, Homo sapiens
EIVMTQSPATLSVSPGERATLSCRASQSVSSNLAWYQQKPGQAPRLLIYGASTRATGIPARFSGSGSETEFTLTISSLQSEDFAVYYCQQYNHWPPWTFGQGTKVEIK

SEQ ID NO: 5125 - protein, 125 aa, Homo sapiens
QVQLQQWGAGLLKPSETLSLTCGVYGASFSGYYWSWIRQPPGKGLEWIGEINHSGSTNYNPSLKSRVTISVDTSKNQFSLKLNSVTAADTAVYYCARGLWWSLTTLTPRGYFQHWGQGALVTVSS

SEQ ID NO: 5126 - protein, 112 aa, Homo sapiens
EIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 5127 - protein, 127 aa, Homo sapiens
QVQLVESGGGVVQPGRSLRLSCAASGFIFSSYAMHWVRQAPGKGLEWVAVISYDGSNKYYADSVKGRFTISRDNSKNTLYLQMNSLRAEDTAVYYCARDLPHYYGSGSRGGYGMDVWGQGTTVTVSS

SEQ ID NO: 5128 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFAAYYCQQTYSTLLTFGGGTKVEIK

SEQ ID NO: 5129 - protein, 120 aa, Homo sapiens
QVHLQESGPGLVKPSETLSLTCTVSGGSISWYYWSWIRQPPGKGLEWIAYIYYNGSTNYNPSLKSRVTISVDTSKKQISLKLSSLTAADTAVYYCARGPPRLGDLSFWGWGQGTLVTVSS

SEQ ID NO: 5130 - protein, 112 aa, Homo sapiens
DIVMTQSPLSLPVTPGEPASISCRSSQSLLHSNGNIYLDWYIQKPGQSPQLLIYLGSNRASGVPDRFSGSGSGTDFTLKISRVEAEDVGVYYCMQALQTPLTFGGGTKVEIK

SEQ ID NO: 5131 - protein, 133 aa, Homo sapiens
QVQLVESGGGVVQPGRSLRLSCTASGFTFSSYAMHWVRQAPGKGLEWVAVISYDGNNKYYGDSVKGRFTISRDNSKNTLYLQMNSLRAEDTAVYYCAKGADTPHYSGYHFLSVGYYFYGMDVWGQGTTVTVSS

SEQ ID NO: 5132 - protein, 107 aa, Homo sapiens
DIQMTQSPSSLSASVGDRVTITCRASQSISYYLNWYQQKPGKAPQLLIYAASSLQSGVPSRFSGSRSGTDFTLTISSLQPEDFATYYCQQSYSTPFTFGPGTKVDIK

SEQ ID NO: 5133 - protein, 122 aa, Homo sapiens
EVQLLESGGGLVQPGGSMRLSCEASGFTFSSYAMSWVRQAPGKGLEWVSTITGSGHNTYYADSVKGRFTISRDNSNNTLYLQINSLRAEDTAVYYCAKDSRCTHITCYFDYWGQGTLVTVSS

SEQ ID NO: 5134 - protein, 107 aa, Homo sapiens
DIQMTQSPSTLSASVGDRVTITCRASHSITTWLAWYQQKPGKAPKLLIYKTSTLESGVPSRFSGSGSGTEFTLTISSLQPDDFATYYCQQYQSDPWTFGQGTKVEVK

SEQ ID NO: 5135 - protein, 120 aa, Homo sapiens
QVQLVESGGGVVQPGRSLRLSCAASGFTFSSYGMHWVRQAPGKGLEWVAVILYDGSNKYYADSVKGRFTISRDNSKNTLYLQMNSLRAEDTSVYFCARDYGEYTTWFDYWGQGTLVTVSS

SEQ ID NO: 5136 - protein, 108 aa, Homo sapiens
DIQMTQSPSSLSASVGDRVTITCRASQSISSYLNWYQHKPGKAPKLLIYLASSLQSGVPSRFSGSGSGTDFTLTISSLQPEDFATYYCQQSYSTPPWTFGQGTKVEIK

SEQ ID NO: 5137 - protein, 120 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSGSGSYYSFDYWGQGTLVTVSS

SEQ ID NO: 5138 - protein, 109 aa, Homo sapiens
QAVVTQEPSLTVSPGGTVTLTCGSSTGAVTSGHYPYWFQQKPGQAPRTLIYDTSNKHSWTPARFSGSLLGGKAALTLSGAQPEDEAEYYCLLSYSGAVVFGGGTKLTVL

SEQ ID NO: 5139 - protein, 119 aa, Homo sapiens
QVQLVESGGGVVQPGKSLRLSCAASGFTFSTYAMHWVRQAPGKGLEWVAVISFDGSNKYYADSVKGRFTISRDNSKNTLYLQMSSLRTDDTALYYCARADWAWLLLNYWGQGTLVTVSS

SEQ ID NO: 5140 - protein, 112 aa, Homo sapiens
QLVVTQSPSASASLGASVKLTCTLSSGHSSYAIAWHQQQPEKGPRYLLKLNSDGSHSKGDGVPDRFSGSSSGAERYLTISSLQSEDEADYYCQTWGTGFHVVFGGGTKVTVL

SEQ ID NO: 5141 - protein, 129 aa, Homo sapiens
EVQLVQSGAEVKKPGATVKISCKVSGYTFTDYYMHWVQQAPGKGLEWMGLVDPEDGETIYAEKFQGRVTITADTSTDTSYMELSSLRSEDTAVYYCATESRSLGYCSGGSCSSYWFDPWGQGTLVTVSS

SEQ ID NO: 5142 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPSITFGQGTRLEIK

SEQ ID NO: 5143 - protein, 126 aa, Homo sapiens
QVQLVQSGAEMKRPGDSVKVSCMASGYTFAAYAVHWVRQAPGQRLEWMGWIGTGNGDTKYSQKFQGRVSITRDTFASTAYMELSSLRSEDTAVYYCARGGQLVRLTLYYYYALDVWGQGTTVTVSS

SEQ ID NO: 5144 - protein, 112 aa, Homo sapiens
DIVMTQSPLSLPVTPGEPASISCRSSQSLLHSTGYNYLDWYLQKPGQSPQLLIYLGSNRASGVPDRFSGSGSGTAFTLKISRVEAEDVGVYYCMQGLQTPATFGQGTKVEIK

SEQ ID NO: 5145 - protein, 123 aa, Homo sapiens
EVQLVESGGGLVQPGGSLRLSCAASGFTFSDYDMHWVRQVSGQGLEWVSAIGTAADTYYPDSVKGRFTISRENAKNSLYLQMNSLRAGDTAVYYCARAGAPIGYYVSWYFDLWGRGTLVTVSS

SEQ ID NO: 5146 - protein, 108 aa, Homo sapiens
DIQMTQSPSSLSASVGDRVTITCRASQSISRYLNWYQQKPGTAPRLLIYAASSLQSGVPSRISGSGSGTDFTLTISSLQPEDFATYYCQQSYSMPPITFGPGTKVDMK

SEQ ID NO: 5147 - protein, 126 aa, Homo sapiens
QVQLVQSGAEVKKPGASVKVSCKASGYTFTTYGISWVRQAPGQGLEWMGWISAYSGDTKYAQKFQGRVTMTTDTSTRTAYMELRSLRSDDTAVYYCARDYYDSSGYSYYYHGMDVWGQGTTVTVSS

SEQ ID NO: 5148 - protein, 113 aa, Homo sapiens
DIVMTQSPDSLAVSLGERATINCRSSQSVLYTSNNKHYLAWYQQKPGQPPKLLIYWASTRESGVPDRFSGSGSGTDFTLTISSLQAEDVAVYYCQQYYSTPFTFGPGTKVDIK

SEQ ID NO: 5149 - protein, 131 aa, Homo sapiens
QMQLVQSGAEVKKPGSSVKVSCKASGGTFSSDAISWVRQAPGQGLEWMGRISPILGIANYAQKFQGRVTITADKSTSTAYMELSSLRSEDTAVYYCARDVMDSGSYYRIEIGYYYYGMDVWGQGTTVTVSS

SEQ ID NO: 5150 - protein, 107 aa, Homo sapiens
EIVLTQSPATLSLSPGERATLSCRASQSVSSDLAWYQQKPGQAPRLLIYNASNRATGIPARFSGSGSGTDFTLTISRLEPADFAVYYCQQRSNWPLTFGGGTKVEIK

SEQ ID NO: 5151 - protein, 127 aa, Homo sapiens
QVQLQESGPGLVKPSQTLSLTCSVSGGSIINGHYYWSWIRQPAGKGLEWIGRIHTSGGTNYIPSLKSRVTISVDTSKNQFSLKLRSVTAADTAVYYCAREEYCSGDNCSRANWFDPWGQGTLVTVSS

SEQ ID NO: 5152 - protein, 111 aa, Homo sapiens
QSVLTQPPSVSGAPGQRVTISCTGSSSNIGAGYGVHWYQQLPGIAPKLLIYGNTNRPSGVPDRFSGSKSGTSASLALTGLQADDEADYYCQSYDSSLSDVVFGGGTKLTVL

SEQ ID NO: 5153 - protein, 123 aa, Homo sapiens
EVQLVESGGGLVQPGGSLRLSCAASGFTFSSYDMHWVRQATGKGLEWVSLIGTAGDTYYPDSVKGRFTISRENAKNSLYLQMNSLRAGDTAVYYCARGYYDNSGYYSLGMDVWGQGTTVTVSS

SEQ ID NO: 5154 - protein, 108 aa, Homo sapiens
DIQMTQSPSSLSASVGDRVTITCRASQSISSYLNWYQQKPGKAPKLLIYAASSLQSGVPSRFSGSGSGTDFTLTISSLQPGDFATYYCQQSYIMPHYTFGQGTKLEIK

SEQ ID NO: 5155 - protein, 134 aa, Homo sapiens
EVQLVESGGGLVQPGGSLRLSCAASGFIFSSYNMNWVRQAPGKGLEWVSYISYSSSTIYYADSVKGRFTISRDNANNSLSLQMTSLRAEDTAVYYCARDPLLPPLPTAMSGREYYYDYFGMEVWGQGTTVTVSS

SEQ ID NO: 5156 - protein, 107 aa, Homo sapiens
DIQMTQSPSSVSASVGDRVTITCRASQGISRWLAWYQQKPGKAPKLLIYGASTLQSGVPSRFSGSGSGTDFTLTISSLQPEDFATYYCQQANSFPYTFGQGTKLEIK

SEQ ID NO: 5157 - protein, 122 aa, Homo sapiens
EVQLVESGGGLIQPGGSLRLSCAASGLTVSSNYMSWVRQAPGKGLEWVSVIYSGGSTYYADSVKGRFTISRDNSKNTLYLQLNSLRAEDTAVYYCARVGGYCSGSNCYSDYWGQGTLVTVSS

SEQ ID NO: 5158 - protein, 107 aa, Homo sapiens
DIQMTQSPSSLSASLGDRVTITCQASQDIRNYLNWYQQKPGKAPKLLIYDVSNLETGVPSRFSGSGSGTDFAFTISSLQPEDIATYYCQQYDNLPITFGQGTRLEIK

SEQ ID NO: 5159 - protein, 127 aa, Homo sapiens
QVQLVESGGGVVQPGRSLRLSCAASGFTFSAYGMHWVRQAPGKGLEWVAVIWYDGSDEYYADSVKGRFTISRDNSKNTVYLQMNSLGAEDTAVYYCAKDRLGYCSGGSCYGGALAYWGQGTLVTVSS

SEQ ID NO: 5160 - protein, 112 aa, Homo sapiens
DVVMTQSPLSLPVTPGEPASISCRSSQSLLHSNGYNHLDWYLKKPGQSPQLLIYLGSTRASGVPDRFSGSGSGTDFTLKISRVEAEDVGVYYCMQTLHSPFTFGPGTTVDIR

SEQ ID NO: 5161 - protein, 124 aa, Homo sapiens
EVHLVQSGAEVKKPGESLKISCKGSGNSFTDYWIGWVRQMPGKGLEWMGIIYPDDSNIRYSPSFQGQVTISADKSITTAYVQWSSLKASDTAMYYCARLAYPSTVTTELHFDYWGPGTLVTVSS

SEQ ID NO: 5162 - protein, 106 aa, Homo sapiens
SYELTQPPSVSVSPGQTASITCSGDKLGDKYASWYQQKPGQSPVVVIYEDSKRPSGIPERFSGSKSGNTATLTISGTQAMDEADYYCQAWDTIYVVFGGGTKLTVL

SEQ ID NO: 5163 - protein, 122 aa, Homo sapiens
QVQLQESGPGLVKPSETLFLTCTVSGYSISSPYYWGWIRQPPGKGLEWIGSSDDTGSTYYNPSLKSRVAISVDTSKNQFSLKLSSVTAADTAVYYCVRDPDDSSDYRTFDYWGQGTLVTVSS

SEQ ID NO: 5164 - protein, 107 aa, Homo sapiens
DIQMTQSPSTLSASVGDRVTITCRASQSINNWLAWYQQKPGKAPKVLIYKASILENGVPSRFSGSGSGTEFTLTISSLQPDDFATYYCQQYSRYPYTFGQGTKLEIK

SEQ ID NO: 5165 - protein, 119 aa, Homo sapiens
EVQLVESGGGLVQPGGSLRLSCAASGFTFSNYDMHWVRQTTGKGLEWVSTIGTSGDTYYPGSVKGRFTISRENGKNSLYLQMNSLRAGDTAVYYCARGYSGYDTVFDYWGQGALVTVSS

SEQ ID NO: 5166 - protein, 108 aa, Homo sapiens
DIQMTQSPSSLSASVGDRVTITCRASQSIRSHLNWYQQKPGKAPKLLIYAASSLQSGVPSRFSGSGSGTDFTLTISSLQPEDFATYYCQQSYTNPPITFGQGTRLEIK

SEQ ID NO: 5167 - protein, 120 aa, Homo sapiens
QVQLVESGGGVVQPGRSLRLSCAASGFTFSSSGMHWVRQAPGKGLEWVAVIWYDGNNKYYGDSVKGRFTISRDNSKNTVYLQMNSLSAEDTAIYYCAKDRLGAGNYFDSWGQGTLVTVSS

SEQ ID NO: 5168 - protein, 109 aa, Homo sapiens
EIVLTQSPATLSLSPGERATLSCRASQSVSSFLAWYQQKAGQAPRLLIYDASNRATGIPARFSGSGSGTDFTLTISSLEPEDFAVYYCQERSNWPPTFTFGPGTKVDIK

SEQ ID NO: 5169 - protein, 121 aa, Homo sapiens
QVQLVESGGGVVQPGRSLRLSCAASGFTFSSYAMHWVRQAPGKGLEWVAAISSEGNNKFYGDSVKGRFTISRDNSKNTLYLQLNSLRAEDTAVYYCAKDLGSSWYDVFDVWGQGTMVTVSS

SEQ ID NO: 5170 - protein, 108 aa, Homo sapiens
DIQMTQSPSSLSASVGDRVTITCRASQTISTYLNWYQQKPGKAPRLLIYAASSLQSGVPSRFSGSASGTDFTLTISSLQPEDFATYYCQQSYSTPPWTFGQGTMVEIK

SEQ ID NO: 5171 - protein, 119 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDLSNLRWYDYWGQGTLVTVSS

SEQ ID NO: 5172 - protein, 108 aa, Homo sapiens; identical to SEQ ID NO: 1012

SEQ ID NO: 5173 - protein, 126 aa, Homo sapiens
QVQLVESGGGVVQPGRSLRLSCAASGFTFSSYAMHWVRQAPGKGLEWVAVISYDGTNKYYADSVKGRFTISRDNSKNTLYLQMNSLRAEDTAVYFCARDYVAVVVADYWYYGMDVWGQGTTVTVSS

SEQ ID NO: 5174 - protein, 116 aa, Homo sapiens
QAVLTQPSSLSASPGASASLTCTLRSGINVGTYRIYWYQQKPGSPPQYLLRYKSDSDKQQGSGVPSRFSGSKDASANAGILLISGLQSEDEADYYCMIWHSSASAVFGGGTKLTVL

SEQ ID NO: 5175 - protein, 121 aa, Homo sapiens
QVLLVQSGTEVKKPGSSVKVSCKASGGPSITKTFGWVRQAPGQGLEWMGRIIPLLGVPNYAQKFQGRVTITADKSTNTVYMELSSLRADDTAVYYCATVGTYCSGDCYSDWGQGTLVIVSS

SEQ ID NO: 5176 - protein, 106 aa, Homo sapiens
EIRMTQSPSSLSASVGERVIITCQASQDISKFVNWYQQKPGKAPKLLIYDASNLERGVPSRFRGNGSGTDFTFTISSMQPEDIARYYCQQYDVLPLFGQGTRVDIK

SEQ ID NO: 5177 - protein, 135 aa, Homo sapiens
QVTLRESGPALVKPTQTLTLTCTFSGFSLNTSGMCVTWIRQPPGKALEWLALIDWDDDKYYNTSLRTRLTISKDTSKNQVVLTMTNMDPVDTATYYCARIPRVRILYYGSGSYPTLIADYGMDVWGQGTTVTVSS

SEQ ID NO: 5178 - protein, 107 aa, Homo sapiens
DTQMTQSPSSLSASVGDRVTITCRASQSISSYLNWYQQKPGKAPKLLIYDASSLQSGVPSRFSGSRSGTDFTLTISSLQPEDFATYYCQQSYDTPRSFGQGTRLEIK

SEQ ID NO: 5179 - protein, 128 aa, Homo sapiens
QVQLVDSGGGVVQPGRSLRLSCAASGFSFSSYAMHWVRQAPGKGLEWVALISYDGSDKYSADSVEGRFTISRDNSKNTLYLQMNSLRAEDTALYYCARDLPKNSSGWFVDYYYGMDVWGQGTTVTVSS

SEQ ID NO: 5180 - protein, 107 aa, Homo sapiens
DIQLTQSPSSVSASVGDRVTITCRASQGISTWLAWYQQKPGKAPKLLIHAASSLQSGVPSRFSGSGSGTDFTLTIGSLQPEDFATYYCQQANSFPLTFGPGTKVDIR

SEQ ID NO: 5181 - protein, 122 aa, Homo sapiens
QVQLVQSRAEVKKPGASVKVSCKASGYTFISYYMHWVRQAPGQGLEWMGTINPSGGSTIYAQKFQGRVTMTRDTSTSTVYMELSSLRSEDTAVYYCATGDDYGDYRGWFDPWGQGTLVTVSS

SEQ ID NO: 5182 - protein, 110 aa, Homo sapiens
EIVLTQSPATLSLSPGERATLSCRASQSVFNYLAWYQQKPGQAPRLLIYDASNRATGIPARFSGSGSGTDFTLTISSLEPEDFAVYYCHQRSTWPPGGFTFGPGTKVDIK

SEQ ID NO: 5183 - protein, 122 aa, Homo sapiens; identical to SEQ ID NO: 5163

SEQ ID NO: 5184 - protein, 107 aa, Homo sapiens
DIQMTQSPSSLSASVGDRVTITCRASQGIKIYLVWLQQKPGKAPKSLIYAASSLQSGVPSKFSGSGSGTDFTLTISSLQPEDFATYYCQQYYSYPLTFGGGTKVEIK

SEQ ID NO: 5185 - protein, 123 aa, Homo sapiens
QVQLVESGGGVVQPGRSLRLSCAASGFTFSTYGMHWVRQAPGKGLQWVAVISYDGSNKYYADSVKGRFTISRDNSKNKVYLQMNSLRAEDTAVYYCAKDREIVVVVAAGLDYWGQGTLVTVSS

SEQ ID NO: 5186 - protein, 106 aa, Homo sapiens
SYELTQPPSVSVSPGQTASITCSGDDLGYKYACWYQQKPGQSPVLVIYQYNKRPSGIPERFSGSNSGNTATLTISGTQAMDEADYYCQAWDSSTVVFGGGTKLTVL

SEQ ID NO: 5187 - protein, 129 aa, Homo sapiens
QVQLVQSGSVLKKPGASVKVACKASGYTFDNFAINWVRQAPGQGLEWMGWLNTKTGTPTYAQGLRGRFVFSLDTSVNTAYLQISSLKAEDTAVYYCARVATTVQGVIITLDYYYGMDVWGQGTTVTVSS

SEQ ID NO: 5188 - protein, 111 aa, Homo sapiens
QSALTQPASVSGSPGQSITISCTGTSSDVGGYNYVSWYQQYPGEAPKLVIYDVSNRPSGVSNRFSGSKSGNTASLTIAGLRAADEADYYCTSSTSSSTLVVFGGGTKLSVL

SEQ ID NO: 5189 - protein, 121 aa, Homo sapiens
QVQMVESGGGVVQPGRSLRLSCAASGFTFSSYAMHWVRQAPGKGLEWVAVISYDGNNKYYADSVRGRFTISRDNSKNTLYLQMNSLRAEDTAVYYCAKSRGGSYSSPFDIWGQGTMVTVSS

SEQ ID NO: 5190 - protein, 107 aa, Homo sapiens
EIVLTQSPGTLSLSPGERATLSCRASQRVSSSYLAWYQQKPGQAPRLLIYGASSRATGIPDRFSGSGSGTDFTLTISRLEPEDFAVYYCQQYHLGLTFGGGTKVEIK

SEQ ID NO: 5191 - protein, 117 aa, Homo sapiens
EVQLVESGGGLIQPGGSLRLSCAASGVTVSNNYMSWVRQAPGKGLEWVSLLYSGGTTYYADSVKGRFTISRDNSKNTLYLQMNSLRAEDTAVYYCARDLVAYGMDVWGQGTTVTVSS

SEQ ID NO: 5192 - protein, 107 aa, Homo sapiens
DIQLTQSPSFLSASVGDRVTITCRASQGISNYLAWYQQKAGKAPKLLIYAASTLQSGVPSRFSGSGSGTEFTLTISSLQPEDFATYYCQQLNSDLITFGQGTRLEIK

SEQ ID NO: 5193 - protein, 127 aa, Homo sapiens
QLQLQESGPGRVKPSETLSLTCTVSGGSISNINYYWAWIRQPPGKGLEWIGNMYHSGSTYYNPSLKSRVIISVDTSKNQISLKLSSVTAADTAVYYCASERFGDLLGGFNFGGMDVWGQGTTVTVSS

SEQ ID NO: 5194 - protein, 113 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYNTPRTFGQGTKVEIK

SEQ ID NO: 5195 - protein, 127 aa, Homo sapiens
QVQLVESGGGVVQPGRSLRLSCAASGFTFSSYGMHWVRQAPGKGLEWLAVISYDGTKIYYADSVKGRFTISRDNSKNTLYLQMNSLRAEDTAVYYCAKQGGPYCSGGDCYSGDFDYWGQGTLVTVSS

SEQ ID NO: 5196 - protein, 109 aa, Homo sapiens
EIVLTQSPGTLSLSPGERATLSCRASQSVSSSYLAWYQQKPGQAPRLLISGASSRATGIPDRFSGSGSGTDFTLTISRLEPEDFAVYYCQQYGSSPPLTFGGGTKVEIK

SEQ ID NO: 5197 - protein, 119 aa, Homo sapiens
QMQLQQWGAGLLKPSETLSLTCAVSGGSLSGSYWTWIRQPPGQGLEWIGEIIHSGSTNYNPSLKSRVTISVDTSRNQFSLKLASMTAADTAIYYCARGLWIGGSWYDYWGQGTLVTVSS

SEQ ID NO: 5198 - protein, 107 aa, Homo sapiens
DIQMTHSPSSLSASVGDRVTITCRTSQNIRTYLNWYQQRPGKAPKLLISAASNLHSGVPSRFSGSGSGTDFTLTVSSLQPEDFATYYCQQSYSIPYTFGQGTKLEIK

SEQ ID NO: 5199 - protein, 121 aa, Homo sapiens
EVQLLESGGGLVQPGGSLRLSCAPSGFTFSSYAMNWVRQAPGKGLEWVSTISYTGGNTFYANSVKGRFTISRDNSKNTLYLQMNSLRVEDTAVYYCAKATTMVQGVDFDYWGQGTLVTVSS

SEQ ID NO: 5200 - protein, 107 aa, Homo sapiens
DIQMTQSPSSLSASVGDRVTITCRASQSVSSYLNWYQQKPGKAPKLLIYAASSLQSGVPSRFSGSGSGTDFTLTISSLQPEDFATYYCQQSYSPPVTFGGGTKVEIK

SEQ ID NO: 5201 - protein, 121 aa, Homo sapiens
QLQLQESGPGLVKPSETLSLTCTVSGGSISSSTSYWGWIRQPPGKGLEWIGTIYYTGSTYYNPSLKSRVTISVDTSKNQFSLMLTSVTAADTAVYYCARDSLDLSLLFDYWGQGTLVTVSS

SEQ ID NO: 5202 - protein, 111 aa, Homo sapiens
QVVLTQSPSASASLGASVKLTCTLSSGHSGYAIAWHQQQPEKGPRYLMRLNSDGSHSKGDGIPDRFSGSSSGAERYLTISSLQSEDEADYYCQTWGTGIRVFGGGTKLTVL

SEQ ID NO: 5203 - protein, 136 aa, Homo sapiens
EVQLVESGGGLVKPGRSLRLSCSSSGFTFRDYAMTWFRQAPGKGLEWVGFIRSKAYGGTTEYAASVKDRFTISRDDSKSIAYLQMNSLKTEDTAVYYCSRSKPLYYSGSGTSYKGEEYDYYGMDVWGQGTTVTVSS

SEQ ID NO: 5204 - protein, 107 aa, Homo sapiens
DIQLTQSPSFLSASVGDRVTITCRASQGVSSYLAWYQQKPGMAPKLLIYAASILQSGVPSRFSGSGSGTEFTLTITSLQPEDFATYYCQQLNSYPRTFGPGTKVDIN

SEQ ID NO: 5205 - protein, 121 aa, Homo sapiens
EVQLVQSGAEVKKPGATVKISCRVSGYTFNDYYIHWVQQAPGKGLEWMGLVDPEDGETIYAEKFQGRVTITADTSTDTAYMELSSLRYEDTAVYYCATDIDCTGGSCYPYWGQGTLVTVSS

SEQ ID NO: 5206 - protein, 107 aa, Homo sapiens
DIQMTQSPSSLSASVGDRVTITCRASQGIRNDLGWYQQKPGKAPKRLIFAASFLQSGVPSRFSGSGSGTEFTLTISSLQPEDFATYYCLQHNSYPLTFGQGTKVEIK

SEQ ID NO: 5207 - protein, 117 aa, Homo sapiens
QVQLVESGGGVVQPGRSRRLSCAASGFTFSSYAMHWVRQAPGKGLEWVALISYDGSNKYYADSVVGRFTISRDNSKNTLYLQMSSLRPEDTAVYYCARAQADGMDVWGQGTTVTVSS

SEQ ID NO: 5208 - protein, 106 aa, Homo sapiens
SYELTQAPSVSVSPGQTAIIPCSGDKLGDKYASWYQQKPGQSPVLVISQDTKRPSGIPDRFSGSNSGNTATLTISGTQAMDEADYYCQAWDSRTAVFGGGTKLTVL

SEQ ID NO: 5209 - protein, 122 aa, Homo sapiens
EVQLVESGGVVVQPGGSLRLSCAASGFTFDDYAMHWVRQAPGKGLEWVSLITWDGGSTYYPDSVKGRFTISRDNSKNSLYLQMNSLRTEDTAFYYCAKDIGNSPAGNSFSEWGQGTLVTVSS

SEQ ID NO: 5210 - protein, 109 aa, Homo sapiens
EIVLTQSPATLSLSPGERATLSCRASQSVSTYLAWYQQKSGQAPRLLIFDASSRATGIPARFSGSGSGTDFTLTISSLEPEDFAVYFCQQRSIWPPEFTFGPGTKVDLK

SEQ ID NO: 5211 - protein, 128 aa, Homo sapiens
QVTLRESGPALVKPTQTLTLTCTFSGFSLSTSGMCVSWIRQPPGKALEWLALIDWDDDKYYSTSLKTRLTISKDTSKNQVVLTMTNMDPVDTATYYCARMPVDMSTVGGYYYYGMDVWGQGTTVTVSS

SEQ ID NO: 5212 - protein, 110 aa, Homo sapiens
QSVLTQPPSASGTPGQRVTISCSGSSSNIGNNYVYWYQHLPGTAPKLLIYKNNQRPSGVPDRFSGSKSGTSASLAISGLRSEDEADYYCAAWDDTLNTWVFGGGTKLTVL

SEQ ID NO: 5213 - protein, 116 aa, Homo sapiens
EVQLLESGGGLVQPGGSLRLSCAASGFTFSSYAMSWVRQAPGKGLEWVSGISAGGGSTYYADSVKGRFTISRDNSKNTLYLQMNSLRAEDTAVYYCAKGGDYGVYWGQGTLVTVSS

SEQ ID NO: 5214 - protein, 106 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGWVFGGGTKLTVL

SEQ ID NO: 5215 - protein, 120 aa, Homo sapiens
EVQLVQSGAEVKKPGESLKISCKGSGYSFTDYWIAWVRQMPGKGLEWMGIIYPDDSDTRYSPSFEGQVTISADKSISTAYLQWSRLKASDTAMYYCGRLTGQVLWGFDYWGQGTLVTVSS

SEQ ID NO: 5216 - protein, 108 aa, Homo sapiens
EIVLTQSPGTLSLSPGERATLSCRASQSVSSNYLAWYQQKPGQAPRLLIYGVSRRATGIPDRFSGSGSGTDFTLTISRLEPEDFAVYYCQHYGSSRGTFGQGTKVEIK

SEQ ID NO: 5217 - protein, 127 aa, Homo sapiens
EVQLLESGGGLVQPGGSLRLSCAASGFTFSSYAMSWVRQAPGKGLEWVSGISDSGGSTYYADYVKGRFTISRDNSKDTLYLQMNSLRAEDTAVYYCAKDRGNEYALTHYYYYAMDVWGQGTTVTVSS

SEQ ID NO: 5218 - protein, 107 aa, Homo sapiens
DIQMTQSPSSLSASVGDRVTITCRASQSISSYLNWYQQKPGKAPKLLIYAAYSLQSGVPSRFSGGGSGTDFTLTISSLQPEDFATYFCQQSYSTPITFGQGTRLEIK

SEQ ID NO: 5219 - protein, 122 aa, Homo sapiens
QVQLVQSGAEVRKPGASVTVSCKASGDTFTNYYMHWVRQAPGQGGLEWLGVINPSGDSTRFAQRYQGRVTMTRDTSTSTIYMALSSLRSEDTAVYYCARVYDMFGYNWFDPWGQGTLVTVSS

SEQ ID NO: 5220 - protein, 111 aa, Homo sapiens
QSVLTQPPSVSGAPGQRVTISCTGSSSNIGAGYDVHWYQQLPGTAPKLLIYGNSNRPSGVPARFSGSKSGTSASLAITGLQAEDEADYYCQSYDNSLSGVVFGGGTKLTVL

SEQ ID NO: 5221 - protein, 122 aa, Homo sapiens
QVQLVESGGGVVQPGRSLRLSCAASGFTFSNYGMHWVRQAPGKGLEWVAVIWFDGSNKFYADSVKGRFTISRDNSKDTLYLQMNSLRAEDTAVYYCAKDGLPFRIQLWTDYWGQGSLVTVSS

SEQ ID NO: 5222 - protein, 107 aa, Homo sapiens
DIQMTQSPSSVSASVGDRVTISCRASQGISTWLAWYQHKAGKAPKLLIYDASSLQSGVPSRFSGSGSGTDFTLSISSLQPEDFATYYCLQSTSFPPTLGQGTKLEIK

SEQ ID NO: 5223 - protein, 127 aa, Homo sapiens
QVRLVESGGGVVQPGRSLRLSCAASGLTFRNYGMYWVRQAPGKGLEWMAVISYDGDDKYYADSVKGRFTISRDNSKNTLYLQMNSLRAEDTAVYYCAKASGPYCSGGSCYRAALDYWGQGTLVTVSS

SEQ ID NO: 5224 - protein, 107 aa, Homo sapiens
DIQMTQSPSSLSASVGDRVTITCQASQDISNYLNWYQQKPGKAPKLLIYETSNLETGVPSRFSGSGSGTDFTFTISSLQPEDIATYYCQQYDGLPLTFGGGTKVDIK

SEQ ID NO: 5225 - protein, 129 aa, Homo sapiens
QVQLQQSGPGLVKPSQTLSLTCAISGDSVSSNHVAWNWIRLSPSRGLEWLGRTYYRSKWYNDYAVSVKSRMSISPVTSKNQFSLQLNSVTPEDTAVYFCARDLLVVGIAAAGNHWFDPWGQGTLVTVSS

SEQ ID NO: 5226 - protein, 111 aa, Homo sapiens
QSVLTQPPSASGTPGQRVTISCSGSTFNIGSNTVNWYQQLPGTAPKLLICCNNQRPSGVPDRFSGSKSGTSASLAISGLQSEDEADYYCAAWDDSLNGFYVFGTGTKVTVL

SEQ ID NO: 5227 - protein, 120 aa, Homo sapiens
QVQLVESGGGVVQPGRSLRLSCAASGSTFSSYAMHWVRQAPGKGLQWVAVISFDGSNKYYADSVKGRFTISRDNSKNTLYLQMNNLRPVDTAVYYCARDRTSMAGPFDYWGQGTLVTVSS

SEQ ID NO: 5228 - protein, 106 aa, Homo sapiens
SYELTQPPSVSVSPGQTASITCSGDKLGDKYVYWYQQKTGQSPLLVIYRDTTRPSGIPERFSGSNSGNTATLTISGTQAMDEADYYCQAWDSSAVVFGGGTKLTVL

SEQ ID NO: 5229 - protein, 115 aa, Homo sapiens
QVQLQESGPGLVKPSETLSVTCTVSGDSISGYFWSWLRQPPGKGLEWIGHIYYSGSSGSTNYNPSLKSRVTISVDTSKNQFSLKLSSVTAADTAVYYCARGFDPWGQGTLVIVSS

SEQ ID NO: 5230 - protein, 108 aa, Homo sapiens
EIVLTQSPGTLSLSPGEIATLSCRASQSVSSSYLAWYQQKLGQAPRLLIYAASSRAIGIPDRFSGSGSGTDFTLTISRLEPEDFAVYYCQQYGSSPWTFGQGTKVEIK

SEQ ID NO: 5231 - protein, 122 aa, Homo sapiens
EVQLVESGGGLVQPGGSLKVSCAAHGFTFSGSAIHWVRQAPGKGLEWVARIRTKVNNYATAYTTSVQGRFTVSRDDSKNTAYLEMNRLKIEDTAVYFCTRLHPTVERLFDYWGQGTLVTVSS

SEQ ID NO: 5232 - protein, 110 aa, Homo sapiens
QSVLTQPPSASGTPGQRVTLSCSGSNSNIGTNYGNWYQQLPGAAPKLLIYKNDQRPSGVPDRFSGSKSGTSASLAISGLRSEDEADYYCATWDDRLRRWVFGGGTKLTVL

SEQ ID NO: 5233 - protein, 131 aa, Homo sapiens
QVQLVESGGGVVQPGRSLRLSCAASGFTFSSYAMHWVRQAPGKGLEWVAVISYDGSNKYYTDSVKGRFTISRDNSKNTLYLQMNSLRPEDTAVYYCARDRLFYDGSGYYLQAFYQYGMDVWGQGTTVTVSS

SEQ ID NO: 5234 - protein, 109 aa, Homo sapiens
AIQLTQSPSSLSASVGDRVTITCRASQGISSALAWYQQKPGKAPKLLIYDASTLESGVPSRFSGSGSGTDFTLTISSLQPEDFATYYCQQFNNYPPLFTFGPGTKVDLK

SEQ ID NO: 5235 - protein, 127 aa, Homo sapiens
QVQLQESGPGLVKPSQTLSLTCTVSGGSISSGSYFWSWIRQPAGKGLEWIGRIYTSGNTNYNPSLKSRVTISVDTSKNQFSLKLSSVTAADTAVYYCARYESSITIFGVAHYGMDVWGQGTTVTVSS

SEQ ID NO: 5236 - protein, 108 aa, Homo sapiens
EIVLTQSPGTLSLSPGERATLSCRASQTVSSGYLAWYQQKPGQAPRLLIYGASSRATGIPDSFSGSGSGTDFTLTISRLEPEDFAMYYCQQYGRLPLTFGGGTKVEIK

SEQ ID NO: 5237 - protein, 118 aa, Homo sapiens
EVHLVESGGGLIKPGGSLRLSCAASGFTFSNAWMSWVRQAPGKGLEWVGRIKSKNNGGTADYTAPVAGRFTMSRDDSEDTLDLQMNSLKTEDTGVYYCTTGWNYGASWGQGTLVTVSS

SEQ ID NO: 5238 - protein, 107 aa, Homo sapiens
EVVLTQSPATLSLSPGERATLSCRASQSVSSNLAWYQQKPGQAPRLLIFDASNRATDIPARFSGSGSGTDFTLTISSLEPEDFAVYYCQQRGNWPLTFGGGTKVEIK

SEQ ID NO: 5239 - protein, 124 aa, Homo sapiens
QVQLQESGPGLVKPSQTLSLTCTVSGGSIKSADYYWSWIRQHPGKGLEWIGYIYYSGSTYYNPSLRSRLTISVDTSKSQFSLKLSSVTAADTAVYYCARVRGYCSSTKCHVDYWGQGTLVTVSS

SEQ ID NO: 5240 - protein, 109 aa, Homo sapiens
EFVLTQSPTTLSLSPGERATLSCRASQSVSNYLAWYQQKPGQAPRLLIYDASNRATGIPARFSGSGSGTDFTLTISSLEPEDFAVYYCQQRSDWPPGITFGQGTRLEVK

SEQ ID NO: 5241 - protein, 119 aa, Homo sapiens
EVQLVESGGGLVKPGGSLRLSCAASGFTFSNAWMSWVRQAPGKGLEWVGRIKSKSDGGTTDYAAPVKGRFTISRDDSKNTLYLQMNSLKTEDTAVYYCERGGIWYLDWWGQGTLVTVSS

SEQ ID NO: 5242 - protein, 109 aa, Homo sapiens
QSVLTQPPSASGTPGQRVTISCSGSSSNIGSNYVYWYQQLPGTAPKLLIYRNSQRPSGVPDRFSGSKSGTSASLAISGLRSEDEADYYCAAWDDSLRRVFGGGTKLTVL

SEQ ID NO: 5243 - protein, 125 aa, Homo sapiens
QVQLVQSGAEVKKPGSSVKVSCKASGDTFSNYAISWVRQVPGQGLEWMGRIIPIVGIANYAQKFRGRVTITADTSTNTAYMELSSLRSEDTAVYYCGKLFGGRPQHPPPSRFDFWGQGTLVTVSS

SEQ ID NO: 5244 - protein, 112 aa, Homo sapiens
EIVMTQSPITLPVTPGEPASISCRSSQSLLHSNGYNYVDWYLEKPGQSPQLLIYLGSNRASGVPDRFSGSGSGTDYTLKISRVEAEDVGVYYCMQVLQTPLSFGGGTKVEIK

SEQ ID NO: 5245 - protein, 127 aa, Homo sapiens
QVQLVQSGAEVKKPGSSVKVSCKASGGTFSSYTFSWVRQAPGQGLEWMGRIIPILGITNYAQKFQGRVTITADKSTSTAYMELRSLRSEDTAVYYCAIDTYYYDSSGLYTEETIDRWGQGTLVTVSS

SEQ ID NO: 5246 - protein, 113 aa, Homo sapiens
DIVMTQSPASLSVSLGERATINCKSSQSVLHSSNNKYHLAWYQQKPGQPPKVLIYWASTRESGVPDRFSGSGSGTDFTLTISSLQAEDVAVYYCQQYYSTPLTFGGGTKVEIK

SEQ ID NO: 5247 - protein, 121 aa, Homo sapiens
EVQLVNSGGGLVRPGGSLRLSCAASGFIFSDYSINWVRQSPGKGLEWVSSISSRSNFTYFADSVEGRFTVSRDNAKKSLFLHMNSLRVEDTAVYYCARDRVGRGREALDIWGQGTMVTVSS

SEQ ID NO: 5248 - protein, 107 aa, Homo sapiens
DVQLTQSPSTLSAYVGDRVTITCRASQGITRWLAWYQQKPGKPPKLLIYKASTLETGVPSRFSGTGFGTEFTLTISNLQPDDFATYYCQQYDNYQYTFGQGTKLQIR

SEQ ID NO: 5249 - protein, 118 aa, Homo sapiens
QVQLVQSGSELKKPGASVKVSCKASGYTFTTYAMNWVRQAPGQGLEWMGWINTNTGNPTYAQGFTGRFGFSLDTSANTAYLQISSLKAADTAVYYCGRLRGPGAFDIWGQGTMVTVSS

SEQ ID NO: 5250 - protein, 107 aa, Homo sapiens
DIQMTQSPSSLSASVGDRVTITCQASQDISNYLNWYQQKPGKAPKLLIYAASNLETGVPSRLSGVGSGTHFTFTISSLQPEDIATYYCQQYSNLPITFGQGTRLEIK

SEQ ID NO: 5251 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAAYYCARVGGGSYFGGFDYWGQGSLVTVSS

SEQ ID NO: 5252 - protein, 105 aa, Homo sapiens
DIQMTQSPSTLSASVGDRVTITCRASQSISSWLAWYQQKPGKAPKLLIYKASSLESGVPSRFSGSGSGTEFTLTISSLQPDDLATYYCQQFKSYSFGEGTKVEIK

SEQ ID NO: 5253 - protein, 121 aa, Homo sapiens
QLQLQESGPGPVRPSETLSLNCTVSGGSISSSGYYWGWVRQSPGKGLEWIGSIYYSGRTSNNPSLKSRVTISIDRSKNQFSLSLGSVTAADTAVYYCARQGYMHIPYWDFWGQGALVTVSS

SEQ ID NO: 5254 - protein, 107 aa, Homo sapiens
DIQMTQSPSSLSASVGDRVTFTCRASQSISTYLNWYQQHPGKAPRLLIYAASHLQSGVPLRFSGSGSGTDFTLAISSLQPEDFATYFCQQTYSTPQTFGQGTKLEIN

SEQ ID NO: 5255 - protein, 119 aa, Homo sapiens
QVQLVQSGAELKKPGASVNISCKASGYVFTNYFIHWVRQAPGQRPEWMGWINTDTGKTKYSQNLQGRGTITRETSASTAYMDLSSLRNEDTAVYYCARAERASGRFPYWGQGTLVTVSS

SEQ ID NO: 5256 - protein, 107 aa, Homo sapiens
DIQMTQSPSTLSASVGDRVTITCRASQSISGWLAWYQQKPGEVPKILIYRASSLESGVPSRFSGSGSGTQFTLTINSLQPDDFATYYCQQYNGYPYTFGQGTKLEIK

SEQ ID NO: 5257 - protein, 125 aa, Homo sapiens
EVQLVESGGGLVQPGRSLRLSCAASGFTFDDHAMHWVRQAPGKGLEWVSGISWNSGRIGYADSVKGRFTISRDNAKNSLYLQMNSLRAEDTALYYCVKDIRRYSSGFGYYGLDVWGQGTTVTVSS

SEQ ID NO: 5258 - protein, 110 aa, Homo sapiens
QSVLTQPPSMSAAPGQKVTISCSGSSSNIGSNYVSWYQQVPGTAPKLLIYDNNKRPSGIPDQFSGSKSGTSATLDITGLQTGDEADYYCGTWDSSLSAVVFGGGTKLTVL

SEQ ID NO: 5259 - protein, 126 aa, Homo sapiens
QVQLRESGPGLVKPSQTLSLTCTVSGGSISSDNYYWSWIRQPAGKGLEWIGRIHTSGSTNYNPSLKSRVTISADTSKNQFSLKLNSVTAADTAVYYCARDVTLIVVVHRGGWFDPWGQGTLVTVSS

SEQ ID NO: 5260 - protein, 110 aa, Homo sapiens
QSVLTQPPSVSGAPGQRVTISCTGSSSNIGAGYDVHWYQQLPGTAPKLLIYANSNRPSGVPDRFSGSKSGTSASLAITGLQAADEADYYCQSYDSSLRGVFGGGTKLTVL

SEQ ID NO: 5261 - protein, 119 aa, Homo sapiens
QVQLVQSGAEVKKPGASVKVSCKASGYTFINYYVHWVRQAPGQGLEWMGMINPSGDGTSYAQRFQGRVTMASDTSTTTVYMSLNSLRFEDTAMYYCARGATVARIIEYWGQGTLVTVSS

SEQ ID NO: 5262 - protein, 107 aa, Homo sapiens
DIQMTQSPSSVSASVGDRVTITCRASQVIGSWLVWYQQKAGKAPNLLIYGASNLQSGVPSRFSGSGSGTDFTLTISNLQPEDFATYYCQQANSFPLTFGGGTKVEIK

SEQ ID NO: 5263 - protein, 126 aa, Homo sapiens
QVQLVESGGGVVQPGRSLRLSCAASGFTFSNYGMHWVRQAPGKGLEWVAVISYDGTNEYYADSVKGRFTISRDYSKNSLFLQMNSLRPEDTAVYYCAKDLRVLEWLPPSYYDMDVWGQGTTVTVSS

SEQ ID NO: 5264 - protein, 110 aa, Homo sapiens
QSALIQPASVSGSLGQSLTISCTGTSSDVGAYNYVSWYQQFPGRVPKLMIYEVSNRPSGVSSRFSGSRSGNTASLTISGLQAEDEADYYCCSYTSSSTGVFGTGTKVTVL

SEQ ID NO: 5265 - protein, 121 aa, Homo sapiens
QVQLVESGGGLVKPGGSLRLSCAASGFTFSDYYMSWIRQAPGKGLEWVSYISSSGNTIYYADSVKGRFTISRDNAKNSLYLLMNSLRVEDTAVYYCARDRLWVVRGEIDYWGQGTLVTVSS

SEQ ID NO: 5266 - protein, 110 aa, Homo sapiens
QSALTQPASVSGSPGQSITISCTGTSSDVGSYNLVSWYQQHPGKAPKLMIYEGSKRPSGVSNRFSGSKSGNTASLTISGLQAEDEADYYCCSYAGFTTYVFGTGTKVTVL

SEQ ID NO: 5267 - protein, 128 aa, Homo sapiens
EVQLVESGGGLVQPGGSLRLSCAASGFTFSSYWMHWVRQAPGKGLVWVSRINSDGSSKDYADSVKGRFTISRDNAKNTLYLQMNSLRAEDTAVYYCARVAGAIYSSGWYNYKYGMDVWGQGTTVTVSL

SEQ ID NO: 5268 - protein, 114 aa, Homo sapiens
DIVMTQSPDSLAVSLGERATINCKSSQSVLYSSNNKNYLAWYQQKPGQPPKLLIHWASTRESGVPDRFSGSGSGTDFTLTISSLQAEDVAVYYCQQYYSTPRWTFGQGTKVEIK

SEQ ID NO: 5269 - protein, 126 aa, Homo sapiens
EVQLVESGGGLIQPGGSLRLSCAASGFAVSSNYMSWVRQAPGKGLEWVSVIFGGGSTYYADSVKGRFTISRDNSKNTLYLQMNSLRAEDTAVYYCAREIDSSGYVPGLGYYGMDVWGQGTTVTVSS

SEQ ID NO: 5270 - protein, 108 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSVLPLSFGGGTKVEIK

SEQ ID NO: 5271 - protein, 121 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCAKASHGGYYYGMDVWGQGTTVTVSS

SEQ ID NO: 5272 - protein, 112 aa, Homo sapiens
QSALTQPASVSGSPGQSITISCTGTSSDIGGYNYVSWYQQHPGKAPKLMIYEVSNRPSGVSNRFSGSKSGNTASLTISGLQAEDEADYYCSSYTSSSTSLYVFGTGTKVTVL

SEQ ID NO: 5273 - protein, 123 aa, Homo sapiens
QVQPVQSGAEMKKPGASVKVSCRASAYNFTNYGIHWVRQAPGQRLEWMGWINAGNGHTKFSQKFQGRVTITRDTSANTAYMELSSLTSEDTAMYYCALGGGSGWFGYNWFDPWGQGTLVTVSS

SEQ ID NO: 5274 - protein, 113 aa, Homo sapiens
DIVMTQSPDSLAVSLGGRATINCKSSQSVLYSSNNKNYLAWYQQKPGEPPKLLIYWASTRQSGVPDRFSGSGSGTDFTLTITSLQAEDVAVYYCQQYYSTPLTFGGGTKVEIK

SEQ ID NO: 5275 - protein, 112 aa, Homo sapiens
QVQLQESGPGLVKPSETLSLTCTVSGDSISSYYWSWIRQPPGKGLEWIGYIYYSGTTNYSPSLKSRVTISVDTSKNHFSLKLSSVTAADTAVYYCARGFDFWGQGTLVTVSS

SEQ ID NO: 5276 - protein, 108 aa, Homo sapiens
EIVLTQSPGTLSLSPGERATLSCRASQSVSNIYLAWYQQKPGQAPRLLIYATSSRAIGIPDRFSGSGSGTDFTLAISRLEPEDFAVYYCHHYGSSPWTFGQGTKVEIK

SEQ ID NO: 5277 - protein, 120 aa, Homo sapiens
QVQLVESGGGVDQPGRSLRLSCTASGFAVSNSGMHWVRQAPGKGLEWVAFLWDNGRKEDYVDSVKGRFTISRDSSKNTLYLQMNNLRVDDTAVYYCGKALSTSPTPVDSWGHGTLVTVSS

SEQ ID NO: 5278 - protein, 108 aa, Homo sapiens
SYVLTQSPSVSLAPGKTASITCGGDNIGSKSVHWYQQKPGQAPLLVMFFDDDRPSAIPERFSGSNSGNTASLTISRVEAGDEADYYCQVWDSDLRSVVFGGGTKLTVL

SEQ ID NO: 5279 - protein, 118 aa, Homo sapiens
QVHLVESGGGVVQPGKSLRLSCAASGFIFSSFGMHWVRQPPGKGLEWLAVVSYDGSVTKYSDSFEGRFTISRDNSKNTLYLQMDSLRPEDTAIYYCAKGQGTNLLHYWGQGILVTVSS

SEQ ID NO: 5280 - protein, 112 aa, Homo sapiens
DVVLTQSPLSLPVTLGQPASISCRSSESLVYTDGDTYLHWFHQRPGQSPRRLIFKVSHRESGVPDRISGSGSGTDFTLKISRVEAEDVGVYYCMQGTHWPFTFGPGTKVDIK

SEQ ID NO: 5281 - protein, 122 aa, Homo sapiens
QVQLVQSGAEVKKPGSSVKVSCKASGGTFSNYPINWVRQAPGQGLEWMGRIIPILDITNYTQKFQGRVTIIADKSTSTAYMELSSLRSEDTAVYYCARDPGGIRFTVHFDYWGQGTLVTVSS

SEQ ID NO: 5282 - protein, 108 aa, Homo sapiens
EIVLTQSPGTLSLSPGERATLSCRASQSVSSSYLAWYQQRPGQAPRLLIYGASSRATGIPDRFSGSGSGTDFTLTISRLEPEDFAVYYCQHYGSSPVTFGQGTRLEIK

SEQ ID NO: 5283 - protein, 124 aa, Homo sapiens
QVQLQESGPGLVKPSQTLSLTCTVSGDSIGSGGYYWSWLRQLPGKGLEWIGYIYYRGNTYYNPSLKSRVTISLDTSKNQFSLRLTSVTAADTAVYYCASFSEEQLIPTGYFDNWGRGILVTVSS

SEQ ID NO: 5284 - protein, 108 aa, Homo sapiens
EIVMTQSPATLSVSPGERATLSCRASQSVRSNLAWYQQKPGQAPRLLIYDTSIRATGIPARFSGSGSGTEFTLTISSLQSEDFAVYYCQQYNSWPPYTFGQGTKLEIK

SEQ ID NO: 5285 - protein, 121 aa, Homo sapiens
QVQLVESGGGVVQPGRSLRLSCAASGFTFNSYAIYWVRQAPGKGLEWVAVISYDGFNEYYADSVKGRFTISRDNSKNTLYLQMNSLRTEDTAVYYCARPHSGSYFSFFDYWGQGTLVTVSS

SEQ ID NO: 5286 - protein, 107 aa, Homo sapiens
EFVLTQSPGTLSLSPGERATLSCRASQSVSSSYLAWYQQKPGQAPRLLIYGASSRAAGIPDRFSGSGSGTDFTLTISRLEPEDFAVYYCQQYGSSPLFGQGTKLEIK

SEQ ID NO: 5287 - protein, 122 aa, Homo sapiens
EVQLVESGGGLVQPGGSLRLSCAASGFTFSNYDMHWVRQATGKGLEWVSLIGTAGDTYYPGSVKGRFTISRENAKNSLYLQMNSLRAGDTAVYYCARGYYDSSGFYSYFDYWGQGTLVTVSS

SEQ ID NO: 5288 - protein, 108 aa, Homo sapiens
DIQMTQSPSSLSASVGDRVTITCRASQSISSYLNWYQQKPGKAPKVLIYAASSLQSGVPSRFSGSGSGTDFTLTISSLQPEDFATYYCQQSYSMPPYTFGQGTKLEIK

SEQ ID NO: 5289 - protein, 117 aa, Homo sapiens
EVQLVESGGGLIQPGGSLRLSCAVSGFTVSSNYMSWVRQAPGKGLEWVSVVYSGGSTYYADSVRGRFTISRDNSKNTLYLQMNSLRAEDTAVYYCARDHVLSGMDVWGQGTTVTVSS

SEQ ID NO: 5290 - protein, 107 aa, Homo sapiens
DIQMTQSPSSLSASVGDRVTITCQASQDINKYLNWYQQKPGKAPKLLIYDASNLETGVPSRFSGSGSGTDFTFTISSLQPEDIATYYCHQYDNLPRTFGQGTKVEIK

SEQ ID NO: 5291 - protein, 121 aa, Homo sapiens
QVQLVESGGGVVQPGRSLRLSCAASGFTFSGYAMYWVRQAPGKGLEWVAVISYDGSNKYYADSVKGRFTISRDNSKNTLYLQMNSLRAEDRAVYYCARATGGSYYYGMDVWGQGTTVTVSS

SEQ ID NO: 5292 - protein, 108 aa, Homo sapiens; identical to SEQ ID NO: 1296

SEQ ID NO: 5293 - protein, 129 aa, Homo sapiens
EVQLVESGGGLVQPGGSLRLSCAASGFTFSSFWMHWVRQAPGKGLVWVSRIHNDGTSTFYADSVKGRFTISRDNAKNTLYLQMNSLRAEDTAVYFCARDRSVSQYSSGWYHYYYAMDVWGQGTTVTVSS

SEQ ID NO: 5294 - protein, 110 aa, Homo sapiens
ELVLTQSPGTLSLSPGERATLSCRASQSVSSSYSAWYQQKPGQAPRLLIYGATSRATGIPDRFSGSGSGTDFTLTINRLEPEDFAVYYCQQYGGSPPEFTFGPGTKVDIK

SEQ ID NO: 5295 - protein, 126 aa, Homo sapiens
EVQLVQSGAEVKKPGESLKISCKGSGYKFTSYWIAWVRQMPGKGLEWMGVIYPDDSDTRYSPSFQGQVTISADKSINTASLQWSSLKASDTAMYYCARVTYYYVSGSYYNGGMDVWGQGTTVTVSS

SEQ ID NO: 5296 - protein, 109 aa, Homo sapiens
EIVLTQSPGTLSLSPGERATLSCRASQSVSSSYLAWYQQKPGQAPRLLIYGASRRATGIPDRFSGSGSGTDFTLTISRLEPEDFAVYHCQQSGSSLTWTFGQGTKVEIK

SEQ ID NO: 5297 - protein, 124 aa, Homo sapiens
QVQLVESGGGVVHPGRSLRLSCAASGFIFSTRAMHWVRQAPGKGLEWVAVISYDGTNKYYRDSVKGRFTISRDNSKNTLYLQMNSLRPEDAALYYCVRDGDSGWLLVGNWFDVWGQGTLVTVSS

SEQ ID NO: 5298 - protein, 111 aa, Homo sapiens
QSALTQPASVSGSPGQSITISCTGTSSDVGGFNYVSWYQQHPGKAPKLMIYDVSNRPSGVSNRFSGSKSGNTASLTISGLQAEDEADYYCSSYTSSITLYVFGTGTKVIVL

SEQ ID NO: 5299 - protein, 126 aa, Homo sapiens
EVQLVESGGGLVQPGGSLRLSCAASGFIFSSYNMNWVRQAPGKGLEWISYISRSSSTIYYADSVKGRFTISRDNAKNSLYLQMNSLRDEDTAMYYCARDSYDILTGYNSIPPFDYWGQGTLVTVSS

SEQ ID NO: 5300 - protein, 107 aa, Homo sapiens
DIQMTQSPSSLSASVGDRVTITCRASQGIRNDLGWYQQKPGKAPQRLIYAASSLQTGVPSRFSGSGSGTEFTLTISSLQPEDFATYYCLQYNSYPITFGQGTRLEIK

SEQ ID NO: 5301 - protein, 129 aa, Homo sapiens
QVQLVQSGDEVKKPGSSVKVSCKASGGTFSSYAISWVRQAPGQGLEWMGRIIPILGTANYAQRFQGRVTITADKSTSTAYMELSSLRSEDTAVYYCARGGLYFYDSSTYSSDHYYFDSWGQGTPVTVAS

SEQ ID NO: 5302 - protein, 111 aa, Homo sapiens
NFMLTQPHSVSESPGKTVTISCTGSSGSIASNYVQWYQQRPGSAPTTLIYEDNQRPSGVPDRFSGSIDSSSNSASLTISGLKTEDEADYYCQSYDSSNHVLFGGGTKLTVL

SEQ ID NO: 5303 - protein, 119 aa, Homo sapiens
EVQLVESGGGLVQPGGSLGLSCGASRFTFSSYWMSWVRQAPGKGLEWVANIKQDGGEKYYVDSVKGRFTISRDNAKNSLYLQMNSLRAEDTAVYYCVRLGSSSWYFEYWGQGTLVTVSS

SEQ ID NO: 5304 - protein, 106 aa, Homo sapiens
SYELTQPPSVSVSPGQTASITCSGDNLGDKYVCWYQQKPGQSPVVVIYQDNKRPSGIPERFSGSNSGNTATLTIRGTQAMDEADYYCQAWASSTAVFGTGTKVTVL

SEQ ID NO: 5305 - protein, 119 aa, Homo sapiens
EVQLVESGGGLVQPGGSLRLSCAASGFTFSDYWMSWVRQAPGKGLEWVANIKQDGSEKYYVDSVKGRFTISRDNAKNSLNLQMNSLRAEDTAVYYCARENNGDPLFVYWGQGTLVSVSS

SEQ ID NO: 5306 - protein, 107 aa, Homo sapiens
DIQMTQSPSSLSASIGDRVTITCRASHDISSWLAWYQQKPEKAPKSLIYAASSLQSGVPSRFGGSGSGTNFTLTISRLQPEDFVTYYCQQYNRYPYTFGQGTKLEIK

SEQ ID NO: 5307 - protein, 124 aa, Homo sapiens; identical to SEQ ID NO: 4867

SEQ ID NO: 5308 - protein, 107 aa, Homo sapiens
DIQMTQSPSTLSASVGDRVTITCRASQSISSWLAWYQQKPGKAPKLLIYKASSLENGVPSRFSGSGSGTEFTLTISSLQPDDFATYYCQQYNSYSRTFGLGTKVEMK

SEQ ID NO: 5309 - protein, 114 aa, Homo sapiens
QVQLQQWGAGLVKPSETLSLTCAVSGESLCGYYWSWIRQPPGKGLEWIGDITCSGSTTYNEPFKSRVTISVDTSKNQFSLNLTSMTAADTAVYYCSRGRQQLKWGQGTLVTVSP

SEQ ID NO: 5310 - protein, 112 aa, Homo sapiens
DIVMTQSPLSLPVTPGEPASISCRSSQSLLHRNGYKYLDWYLQKPGQSPQLLIYLGSNRASGVPDRFSGSGSGTDFTLKISRVEADDVGVYYCMQTLQIPATFGPGTKVEIK

SEQ ID NO: 5311 - protein, 120 aa, Homo sapiens
QVQLVESGGGVVQPGRSLRLSCAASGFTFSRFTLHWVRQAPGKGLEWVAVISYDGSNKYYADSVKGRFTISRDNSKSTLYLQMNSLRAEDTGVYYCARDPSTVTGYFDYWGQGTLVTVSS

SEQ ID NO: 5312 - protein, 105 aa, Homo sapiens
SYVLTQPPSVSVAPGKTAKISCGGDSIGSKSVHWYQQKPGQAPVLVIYYDNDRPSGIPERFSGSNSGNTATLTISRVEAGDEADYYCQVWDIGVVFGGGTKLTVL

SEQ ID NO: 5313 - protein, 130 aa, Homo sapiens
QVQLQQSGPGLVKPSQTLSLTCAIFGDSVSSNSAAWNWIRQSPSRGLEWLGRTYYRSKWYNHYELSVKSRMTINPDTSKNQFSLHLNSVTPEDTAVYYCARSRSISCSGDCYPGASFDIWGQGTMVTVSS

SEQ ID NO: 5314 - protein, 110 aa, Homo sapiens
QSVLTQPPSASATPGQRVTISCSGSSSSIGSNYVYWYQQLPGTAPKLLIYRNNQRPSGVPDRFSGSKSGTSASLAISGLRSEDEADYYCATWDDSLSGPVFGGGTKMTVL

SEQ ID NO: 5315 - protein, 123 aa, Homo sapiens
QVQLQESGPGLVKPSETLSLTCTVSGGSISTYYWTWIRQPPGKGLEWIGYIYYSGSANYNPSLKSRVTISVDTSKNQFSLKLNSVTAADSAVYFCARERFSLLDGYNGAFDYWGRGTLVTVSS

SEQ ID NO: 5316 - protein, 113 aa, Homo sapiens
DIVMTQSPDSLAVSLGERATINCKSSQSVLYSSNNKNYLAWYQQKPGQPPKMLIHWALTRESGVPDRFSGSGSGTDFTLTISSLQAEDVAVYYCQQYYNAPRTFGQGTKVEIK

SEQ ID NO: 5317 - protein, 1273 aa, Coronavirus
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 5318 - protein, 1255 aa, Coronavirus
MFIFLLFLTLTSGSDLDRCTTFDDVQAPNYTQHTSSMRGVYYPDEIFRSDTLYLTQDLFLPFYSNVTGFHTINHTFGNPVIPFKDGIYFAATEKSNVVRGWVFGSTMNNKSQSVIIINNSTNVVIRACNFELCDNPFFAVSKPMGTQTHTMIFDNAFNCTFEYISDAFSLDVSEKSGNFKHLREFVFKNKDGFLYVYKGYQPIDVVRDLPSGFNTLKPIFKLPLGINITNFRAILTAFSPAQDIWGTSAAAYFVGYLKPTTFMLKYDENGTITDAVDCSQNPLAELKCSVKSFEIDKGIYQTSNFRVVPSGDVVRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSTDLIKNQCVNFNFNGLTGTGVLTPSSKRFQPFQQFGRDVSDFTDSVRDPKTSEILDISPCSFGGVSVITPGTNASSEVAVLYQDVNCTDVSTAIHADQLTPAWRIYSTGNNVFQTQAGCLIGAEHVDTSYECDIPIGAGICASYHTVSLLRSTSQKSIVAYTMSLGADSSIAYSNNTIAIPTNFSISITTEVMPVSMAKTSVDCNMYICGDSTECANLLLQYGSFCTQLNRALSGIAAEQDRNTREVFAQVKQMYKTPTLKYFGGFNFSQILPDPLKPTKRSFIEDLLFNKVTLADAGFMKQYGECLGDINARDLICAQKFNGLTVLPPLLTDDMIAAYTAALVSGTATAGWTFGAGAALQIPFAMQMAYRFNGIGVTQNVLYENQKQIANQFNKAISQIQESLTTTSTALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQAAPHGVVFLHVTYVPSQERNFTTAPAICHEGKAYFPREGVFVFNGTSWFITQRNFFSPQIITTDNTFVSGNCDVVIGIINNTVYDPLQPELDSFKEELDKYFKNHTSPDVDLGDISGINASVVNIQKEIDRLNEVAKNLNESLIDLQELGKYEQYIKWPWYVWLGFIAGLIAIVMVTILLCCMTSCCSCLKGACSCGSCCKFDEDDSEPVLKGVKLHYT

SEQ ID NO: 5319 - protein, 446 aa, Homo sapiens
EVQLVESGGGLIQPGGSLRLSCAASGFTVSSNYMSWVRQAPGKGLEWVSVIYSGGSTYYADSVKGRFTISRDNSKNTLYLQMNSLRAEDTAVYYCARDLQGGGGPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5320 - protein, 214 aa, Homo sapiens
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5321 - protein, 451 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPYSGSYQSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5322 - protein, 215 aa, Homo sapiens
EIVMTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5323 - protein, 461 aa, Homo sapiens
EVQLVESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRFGIDYDYIWGSYRYTTLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5324 - protein, 214 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5325 - protein, 455 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARGPDYYDFWSGYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5326 - protein, 214 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5327 - protein, 450 aa, Homo sapiens
QVQLVESGGGVVQPGRSLRLSCAASGFTFNSYAIHWVRQAPGKGLEWVAVISYDGSNKYYADSVKGRFTISRDNSKNTLYLQMNSLRAEDTAVYYCARGRGGYRSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5328 - protein, 215 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5329 - protein, 463 aa, Homo sapiens
QVQLVESGGGVVQPGRSLRLSCAASGFTFSSYAMHWVRQAPGKGLEWVAVISYDGSNKYYADSVKGRFTISRDNSRNTLYLQMNSLRAEDTAVYYCAKGADTPHYSGYDFLSVGYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5330 - protein, 214 aa, Homo sapiens
DIQMTQSPSSLSASVGDRVTITCRASQSISSYLNWYQQKPGKAPKLLIYAASSFQSGVPSRFSGSRSGTDFTLTISSLQPEDFATYYCQQSYSAPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5331 - protein, 465 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDPPGRDFWSGYYFGAPDYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5332 - protein, 214 aa, Homo sapiens
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5333 - protein, 456 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCARAPIMITFGGVTGHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5334 - protein, 215 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5335 - protein, 455 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDWTQSSGYDYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5336 - protein, 214 aa, Homo sapiens
SYELTQPPSVSVSPGQTARITCSGDALPKQYAYWYQQKPGQAPVVVIYKDSERPSGIPERFSGSSSGTTVTLTISGVQAEDEADYYCQSADSSGTYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5337 - protein, 451 aa, Homo sapiens
QVQLVESGGGVVQPGRSLRLSSAASGFTFSSYAMHWVRQAPGKGLEWVAVISYDGSNKYYADSVRGRFTISRDNSKNTLYLQMNSLRAEDTAVYYCARPKGGSYSDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5338 - protein, 215 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPQSFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5339 - protein, 457 aa, Homo sapiens
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDPTEVGATSEYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5340 - protein, 214 aa, Homo sapiens
SYELTQPPSVSVSPGQTARITCSGDALPKQYAYWYQQKPGQAPVLVIYKDSERPSGIPERFSGSSSGTTVTLTISGVQAEDEADYYCQSADSSGTYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5341 - protein, 446 aa, Homo sapiens
EVQLVESGGGLVQPGGSLRLSCAASGFTVSSNYMSWVRQAPGKGLEWVSVIYSGGSTYYADSVKGRFTISRDNSKNTLYLQMNSLRAEDTAVYYCARDKSSGSGPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5342 - protein, 214 aa, Homo sapiens; identical to SEQ ID NO: 5320

SEQ ID NO: 5343 - protein, 457 aa, Homo sapiens
QVQLVESGGGVVQPGRSLRLSCAASGFTFSSYGMHWVRQAPGKGLEWVAVIWYDGNNKYYADSVKGRFTISRDNSKNTLYLQMNSLRAEDTAVYYCAKDPTWFGELPSYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5344 - protein, 215 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5345 - protein, 458 aa, Homo sapiens
EVQLVESGGGLVQPGGSLRLSCAASGFTFSSYSMNWVRQAPGKGLEWVSYISSSSSTIYYADSVKGRFTISRDNAKNSLYLQMNSLRAEDTAVYYCARDLGARTPWDIVVVPAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5346 - protein, 215 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPNTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5347 - protein, 446 aa, Homo sapiens
EVQLVESGGGLIQPGGSLRLSCAASGFTVSSNYMSWVRQAPGKGLEWVSVIYSGGSTFYADSVKGRFTISRDNSKNTLYLQMNSLRAEDTAVYYCAREVAGTYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5348 - protein, 215 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYCQQANSFPGGTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5349 - protein, 458 aa, Homo sapiens
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARAPEEKSSEIGELVGWGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5350 - protein, 212 aa, Homo sapiens
SYELTQPPSVSVSPGQTASIICSGDKLGDKYACWYQQKPGQSPVLVIYQDSKRPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5351 - protein, 445 aa, Homo sapiens
EVQLVESGGGLIQPGGSLRLSCAASGLTVSSNYMSWVRQAPGKGLEWVSVIYSGGSTYYADSVKGRFTISRDNSKNTLYLQMNSLRAEDTAVYYCARSPYGGNSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5352 - protein, 214 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5353 - protein, 447 aa, Homo sapiens
EVQLVESGGGLVQPGGSLRLSCAASGFTVSSNYMSWVRQAPGKGLEWVSVIYSGGSTFYADSVKGRFTISRDNSKNTLYLQMNSLRAEDTAVYYCARDSGDQLLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5354 - protein, 215 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5355 - protein, 449 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHHSLSSIFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5356 - protein, 215 aa, Homo sapiens
QSALTQPASVSGSPGQSITISCTGTSSDVGDYNYVSWYQQHPGKAPKLMIYEVSNRPSGVSNRFSGSKSGNTASLTISGLQAEDEADYYCSSYTSSSTVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5357 - protein, 448 aa, Homo sapiens
EVQLVESGGGLVKPGGSLRLSCAASGFTFSNAWMSWVRQAPGKGLEWVGHIKSKTDGGTTDYAAPVKGRFTISRDDSKNTLYLQMNSLKTEDTAVYYCTREPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5358 - protein, 214 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYCQQYNSYRYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5359 - protein, 445 aa, Homo sapiens; identical to SEQ ID NO: 5351

SEQ ID NO: 5360 - protein, 214 aa, Homo sapiens
DIQMTQSPSSLSASVGDRVTITCRTSQTIYNYLNWYQQKPGKAPKFLIYAASSFQNGVPSRFSGSGSGTDFTFTISSLQPEDFATYYCQQGYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5361 - protein, 452 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARDRGYAATFGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5362 - protein, 214 aa, Homo sapiens
DIQMTQSPSSLSASVGDRVTITCRASQSISSYLNWYQQKPGKAPKLLISAASSLQSGVPSRFSGSGSGTDFTLTISSLQPEDFATYYCQQSYSTAFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5363 - protein, 455 aa, Homo sapiens
QVQLVQSGAEVKKPGSSVKVSCKASGGTFSNYAISWVRQAPGQGLEWMGRIIPILGIANYAQKFQGRVTITADKSTSTAYMELSSLRSEDTAVYYCARGYYEARHYYYYYAMDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5364 - protein, 214 aa, Homo sapiens
DIQMTQSPSSLSASVGDRVTITCRASQSISSYLSWYQQKPGKAPKLLIYAASSLQSGVPSRFSGSGSGTDFTLTITSLQPEDFATYYCQQSYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5365 - protein, 451 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASSGGYQGPFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5366 - protein, 218 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLLYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5367 - protein, 330 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHAHYTRKELSLSPGK

SEQ ID NO: 5368 - protein, 15 aa, Coronavirus
SNLKPFERDISTEIY

SEQ ID NO: 5369 - protein, 7 aa, Coronavirus
DISTEIY

SEQ ID NO: 5370 - protein, 6 aa, Coronavirus
ISTEIY

SEQ ID NO: 5371 - protein, 15 aa, Coronavirus
IYQAGSTPCNGVEGF

SEQ ID NO: 5372 - protein, 17 aa, Coronavirus
IYQAGSTPCNGVEGFNC

SEQ ID NO: 5373 - protein, 13 aa, Coronavirus
QAGSTPCNGVEGF

SEQ ID NO: 5374 - protein, 15 aa, Coronavirus
QAGSTPCNGVEGFNC

SEQ ID NO: 5375 - protein, 9 aa, Coronavirus
NCYFPLQSY

SEQ ID NO: 5376 - protein, 7 aa, Coronavirus
YFPLQSY

SEQ ID NO: 5377 - protein, 6 aa, Coronavirus
IAWNSN

SEQ ID NO: 5378 - protein, 8 aa, Coronavirus
IAWNSNNL

SEQ ID NO: 5379 - protein, 11 aa, Coronavirus
IAWNSNNLDSK

SEQ ID NO: 5380 - protein, 35 aa, Coronavirus
SNLKPERISTEIYQAGSTPCNGVEGFNCYFPLQSY

SEQ ID NO: 5381 - DNA, 1464 bp, Homo sapiens
aagcttgctcgagccaccatggagacagacacactcctgctatgggtactgctgctctgggttccaggatccactggacaggtgcagctggtgcagtctggggctgaggtgaagaagcctgggtcctcggtgaaggtctcctgcaaggcttctggaggcaccttcagcaactatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaggttactacgaagcgaggcattactactactactacgctatggacgtctggggccaagggaccgcggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaatgataggtttaaaccgaattc

SEQ ID NO: 5382 - DNA, 741 bp, Homo sapiens
aagcttgctcgagccaccatggagacagacacactcctgctatgggtactgctgctctgggttccaggatctactggcgacatccagatgacccagtctccatcctccctgtctgcatctgtaggagacagagtcaccatcacttgccgggcaagtcagagcattagcagctatttaagttggtatcagcagaaaccagggaaagcccctaagctcctgatctatgctgcatccagtttgcaaagtggggtcccatcaaggttcagtggcagtggatctgggacagatttcactctcaccatcaccagtctgcaacctgaagattttgcaacttactactgtcaacagagttacagtacccctcgcacgttcggccaagggaccaaggtggaaatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgctaataggtttaaaccgaattc

SEQ ID NO: 5383 - protein, 13 aa, Homo sapiens
KASGGTFSNYAIS

SEQ ID NO: 5384 - protein, 17 aa, Homo sapiens
RIIPILGIANYAQKFQG

SEQ ID NO: 5385 - protein, 18 aa, Homo sapiens
ARGYYEARHYYYYYAMDV

SEQ ID NO: 5386 - protein, 11 aa, Homo sapiens
RASQSISSYLS

SEQ ID NO: 5387 - protein, 8 aa, Homo sapiens
YAASSLQS

SEQ ID NO: 5388 - protein, 9 aa, Homo sapiens
QQSYSTPRT

SEQ ID NO: 5389 - protein, 13 aa, Homo sapiens
TVSGGSISSYYWS

SEQ ID NO: 5390 - protein, 16 aa, Homo sapiens
RIYTSGSTNYNPSLKS

SEQ ID NO: 5391 - protein, 9 aa, Homo sapiens
AAGYGSIDY

SEQ ID NO: 5392 - protein, 16 aa, Homo sapiens
RSSQSLLHSNGYNYLD

SEQ ID NO: 5393 - protein, 8 aa, Homo sapiens
YLGSNRAS

SEQ ID NO: 5394 - protein, 9 aa, Homo sapiens
MQALQTPRT

SEQ ID NO: 5395 - protein, 13 aa, Homo sapiens
AASGFTFSSYAMH

SEQ ID NO: 5396 - protein, 17 aa, Homo sapiens
VISYDGSNKYYADSVKG

SEQ ID NO: 5397 - protein, 14 aa, Homo sapiens
ARASGGSYFGGMDV

SEQ ID NO: 5398 - protein, 14 aa, Homo sapiens
TGTSSDVGGYNYVS

SEQ ID NO: 5399 - protein, 8 aa, Homo sapiens
YEVSNRPS

SEQ ID NO: 5400 - protein, 11 aa, Homo sapiens
SSYTSSSTLYV

SEQ ID NO: 5401 - protein, 13 aa, Homo sapiens
AASGFTVSSNYMS

SEQ ID NO: 5402 - protein, 16 aa, Homo sapiens
VIYSGGSTYYADSVKG

SEQ ID NO: 5403 - protein, 10 aa, Homo sapiens
ARDLQGGGGP

SEQ ID NO: 5404 - protein, 11 aa, Homo sapiens
RASQGIRNDLG

SEQ ID NO: 5405 - protein, 8 aa, Homo sapiens
YAASSLQS

SEQ ID NO: 5406 - protein, 9 aa, Homo sapiens
LQDYNYPRT

SEQ ID NO: 5407 - protein, 15 aa, Homo sapiens
SVSGGSISSSSYHWG

SEQ ID NO: 5408 - protein, 16 aa, Homo sapiens
SIYYSGSTYYNPSLKS

SEQ ID NO: 5409 - protein, 21 aa, Homo sapiens
AGLRVVITFGGVIPKGGAFDI

SEQ ID NO: 5410 - protein, 14 aa, Homo sapiens
TGTSSDVGGYNYVS

SEQ ID NO: 5411 - protein, 8 aa, Homo sapiens
YDVSNRPS

SEQ ID NO: 5412 - protein, 10 aa, Homo sapiens
SSYTSSSTVV

SEQ ID NO: 5413 - protein, 13 aa, Homo sapiens
AASGFTFSSYAMH

SEQ ID NO: 5414 - protein, 17 aa, Homo sapiens
VISYDGSNKYYADSVKG

SEQ ID NO: 5415 - protein, 14 aa, Homo sapiens
ARPYSGSYQSYFDY

SEQ ID NO: 5416 - protein, 12 aa, Homo sapiens
RASQSVSSSYLA

SEQ ID NO: 5417 - protein, 8 aa, Homo sapiens
YGASSRAT

SEQ ID NO: 5418 - protein, 9 aa, Homo sapiens
QQYGSSPLT

SEQ ID NO: 5419 - protein, 15 aa, Homo sapiens
TVSGGSISSGGYYWS

SEQ ID NO: 5420 - protein, 16 aa, Homo sapiens
YIYYSGSTYYNPSLKS

SEQ ID NO: 5421 - protein, 18 aa, Homo sapiens
ATTMVRGVIRLDHYGMDV

SEQ ID NO: 5422 - protein, 14 aa, Homo sapiens
TGTSSDVGGYNYVS

SEQ ID NO: 5423 - protein, 8 aa, Homo sapiens
YEVSNRPS

SEQ ID NO: 5424 - protein, 10 aa, Homo sapiens
SSYTSSSTLL

SEQ ID NO: 5425 - protein, 13 aa, Homo sapiens
TASGFTFGDYAMS

SEQ ID NO: 5426 - protein, 19 aa, Homo sapiens
FIRSKAYGGTTEYAASVKG

SEQ ID NO: 5427 - protein, 22 aa, Homo sapiens
TRFGIDYDYIWGSYRYTTLFDY

SEQ ID NO: 5428 - protein, 11 aa, Homo sapiens
RASQSISSWLA

SEQ ID NO: 5429 - protein, 8 aa, Homo sapiens
YKASSLES

SEQ ID NO: 5430 - protein, 9 aa, Homo sapiens
QQYNSYSYT

SEQ ID NO: 5431 - protein, 13 aa, Homo sapiens
TVSGGSISSYYWS

SEQ ID NO: 5432 - protein, 16 aa, Homo sapiens
YIYYSGSTNYNPSLKS

SEQ ID NO: 5433 - protein, 19 aa, Homo sapiens
ARGPDYYDFWSGYFYGMDV

SEQ ID NO: 5434 - protein, 12 aa, Homo sapiens
RASQSVSSSYLA

SEQ ID NO: 5435 - protein, 8 aa, Homo sapiens
YGASSRAT

SEQ ID NO: 5436 - protein, 8 aa, Homo sapiens
QQYGSSLT

SEQ ID NO: 5437 - protein, 13 aa, Homo sapiens
AASGFTFNSYAIH

SEQ ID NO: 5438 - protein, 17 aa, Homo sapiens
VISYDGSNKYYADSVKG

SEQ ID NO: 5439 - protein, 13 aa, Homo sapiens
ARGRGGYRSYFDY

SEQ ID NO: 5440 - protein, 12 aa, Homo sapiens
RASQSVSSSYLA

SEQ ID NO: 5441 - protein, 8 aa, Homo sapiens
YGASSRAT

SEQ ID NO: 5442 - protein, 9 aa, Homo sapiens
QQYGSSPNT

SEQ ID NO: 5443 - protein, 13 aa, Homo sapiens
AASGFTFSSYAMH

SEQ ID NO: 5444 - protein, 17 aa, Homo sapiens
VISYDGSNKYYADSVKG

SEQ ID NO: 5445 - protein, 26 aa, Homo sapiens
AKGADTPHYSGYDFLSVGYYYYGMDV

SEQ ID NO: 5446 - protein, 11 aa, Homo sapiens
RASQSISSYLN

SEQ ID NO: 5447 - protein, 8 aa, Homo sapiens
YAASSFQS

SEQ ID NO: 5448 - protein, 9 aa, Homo sapiens
QQSYSAPFT

SEQ ID NO: 5449 - protein, 13 aa, Homo sapiens
KASGYTFTSYYMH

SEQ ID NO: 5450 - protein, 17 aa, Homo sapiens
IINPSGGSTSYAQKFQG

SEQ ID NO: 5451 - protein, 28 aa, Homo sapiens
ARDPPGRDFWSGYYFGAPDYYYYYGMDV

SEQ ID NO: 5452 - protein, 11 aa, Homo sapiens
RASQGISNYLA

SEQ ID NO: 5453 - protein, 8 aa, Homo sapiens
YAASSLQS

SEQ ID NO: 5454 - protein, 9 aa, Homo sapiens
QQYNSYPYT

SEQ ID NO: 5455 - protein, 15 aa, Homo sapiens
TVSGGSISSSSYYWG

SEQ ID NO: 5456 - protein, 16 aa, Homo sapiens
SIYYSGSTYYNPSLKS

SEQ ID NO: 5457 - protein, 18 aa, Homo sapiens
ARAPIMITFGGVTGHFDY

SEQ ID NO: 5458 - protein, 12 aa, Homo sapiens
RASQSVSSSYLA

SEQ ID NO: 5459 - protein, 8 aa, Homo sapiens
YGASSRAT

SEQ ID NO: 5460 - protein, 9 aa, Homo sapiens
QQYGSSPLT

SEQ ID NO: 5461 - protein, 13 aa, Homo sapiens
KASGYTFTSYYMH

SEQ ID NO: 5462 - protein, 17 aa, Homo sapiens
IINPSGGSTSYAQKFQG

SEQ ID NO: 5463 - protein, 18 aa, Homo sapiens
ARDWTQSSGYDYYYGLDV

SEQ ID NO: 5464 - protein, 11 aa, Homo sapiens
SGDALPKQYAY

SEQ ID NO: 5465 - protein, 8 aa, Homo sapiens
YKDSERPS

SEQ ID NO: 5466 - protein, 11 aa, Homo sapiens
QSADSSGTYVV

SEQ ID NO: 5467 - protein, 13 aa, Homo sapiens
AASGFTFSSYAMH

SEQ ID NO: 5468 - protein, 17 aa, Homo sapiens
VISYDGSNKYYADSVRG

SEQ ID NO: 5469 - protein, 14 aa, Homo sapiens
ARPKGGSYSDAFDI

SEQ ID NO: 5470 - protein, 12 aa, Homo sapiens
RASQSVSSSYLA

SEQ ID NO: 5471 - protein, 8 aa, Homo sapiens
YGASSRAT

SEQ ID NO: 5472 - protein, 9 aa, Homo sapiens
QQYGSSPQS

SEQ ID NO: 5473 - protein, 13 aa, Homo sapiens
KASGYTFTSYYMH

SEQ ID NO: 5474 - protein, 17 aa, Homo sapiens
IINPSGGSTSYAQKFQG

SEQ ID NO: 5475 - protein, 20 aa, Homo sapiens
ARDPTEVGATSEYYYYGMDV

SEQ ID NO: 5476 - protein, 11 aa, Homo sapiens
SGDALPKQYAY

SEQ ID NO: 5477 - protein, 8 aa, Homo sapiens
YKDSERPS

SEQ ID NO: 5478 - protein, 11 aa, Homo sapiens
QSADSSGTYVV

SEQ ID NO: 5479 - protein, 13 aa, Homo sapiens
AASGFTVSSNYMS

SEQ ID NO: 5480 - protein, 16 aa, Homo sapiens
VIYSGGSTYYADSVKG

SEQ ID NO: 5481 - protein, 10 aa, Homo sapiens
ARDKSSGSGP

SEQ ID NO: 5482 - protein, 11 aa, Homo sapiens
RASQGIRNDLG

SEQ ID NO: 5483 - protein, 8 aa, Homo sapiens
YAASSLQS

SEQ ID NO: 5484 - protein, 9 aa, Homo sapiens
LQDYNYPRT

SEQ ID NO: 5485 - protein, 13 aa, Homo sapiens
AASGFTFSSYGMH

SEQ ID NO: 5486 - protein, 17 aa, Homo sapiens
VIWYDGNNKYYADSVKG

SEQ ID NO: 5487 - protein, 20 aa, Homo sapiens
AKDPTWFGELPSYYYYGMDV

SEQ ID NO: 5488 - protein, 11 aa, Homo sapiens
RASQSISSWLA

SEQ ID NO: 5489 - protein, 8 aa, Homo sapiens
YKASSLES

SEQ ID NO: 5490 - protein, 10 aa, Homo sapiens
QQYNSYPPIT

SEQ ID NO: 5491 - protein, 13 aa, Homo sapiens
AASGFTFSSYSMN

SEQ ID NO: 5492 - protein, 17 aa, Homo sapiens
YISSSSSTIYYADSVKG

SEQ ID NO: 5493 - protein, 21 aa, Homo sapiens
ARDLGARTPWDIVVVPAAMDY

SEQ ID NO: 5494 - protein, 12 aa, Homo sapiens
RASQSVSSSYLA

SEQ ID NO: 5495 - protein, 8 aa, Homo sapiens
YGASSRAT

SEQ ID NO: 5496 - protein, 9 aa, Homo sapiens
QQYGRSPNT

SEQ ID NO: 5497 - protein, 13 aa, Homo sapiens
AASGFTVSSNYMS

SEQ ID NO: 5498 - protein, 16 aa, Homo sapiens
VIYSGGSTFYADSVKG

SEQ ID NO: 5499 - protein, 10 aa, Homo sapiens
AREVAGTYDY

SEQ ID NO: 5500 - protein, 11 aa, Homo sapiens
RASQGISSWLA

SEQ ID NO: 5501 - protein, 8 aa, Homo sapiens
YAASSLQS

SEQ ID NO: 5502 - protein, 10 aa, Homo sapiens
QQANSFPGGT

SEQ ID NO: 5503 - protein, 13 aa, Homo sapiens
TVSGGSISSYYWS

SEQ ID NO: 5504 - protein, 16 aa, Homo sapiens
YIYYSGSTNYNPSLKS

SEQ ID NO: 5505 - protein, 22 aa, Homo sapiens
ARAPEEKSSEIGELVGWGWFDP

SEQ ID NO: 5506 - protein, 11 aa, Homo sapiens
SGDKLGDKYAC

SEQ ID NO: 5507 - protein, 8 aa, Homo sapiens
YQDSKRPS

SEQ ID NO: 5508 - protein, 9 aa, Homo sapiens
QAWDSSTVV

SEQ ID NO: 5509 - protein, 13 aa, Homo sapiens
AASGLTVSSNYMS

SEQ ID NO: 5510 - protein, 16 aa, Homo sapiens
VIYSGGSTYYADSVKG

SEQ ID NO: 5511 - protein, 9 aa, Homo sapiens
ARSPYGGNS

SEQ ID NO: 5512 - protein, 11 aa, Homo sapiens
QASQDISNYLN

SEQ ID NO: 5513 - protein, 8 aa, Homo sapiens
YDASNLET

SEQ ID NO: 5514 - protein, 9 aa, Homo sapiens
QQYDNLPIT

SEQ ID NO: 5515 - protein, 13 aa, Homo sapiens
AASGFTFSSYAMH

SEQ ID NO: 5516 - protein, 17 aa, Homo sapiens
VISYDGSNKYYADSVKG

SEQ ID NO: 5517 - protein, 14 aa, Homo sapiens
ARAGSGNYYNWFDP

SEQ ID NO: 5518 - protein, 11 aa, Homo sapiens
RASQTVSSNLV

SEQ ID NO: 5519 - protein, 8 aa, Homo sapiens
YGASTRAT

SEQ ID NO: 5520 - protein, 10 aa, Homo sapiens
QQYNNWPPYT

SEQ ID NO: 5521 - protein, 13 aa, Homo sapiens
AASGFTVSSNYMS

SEQ ID NO: 5522 - protein, 16 aa, Homo sapiens
VIYSGGSTFYADSVKG

SEQ ID NO: 5523 - protein, 11 aa, Homo sapiens
ARDSGDQLLDY

SEQ ID NO: 5524 - protein, 11 aa, Homo sapiens
RASQGISSYLA

SEQ ID NO: 5525 - protein, 8 aa, Homo sapiens
YAASTLQS

SEQ ID NO: 5526 - protein, 10 aa, Homo sapiens
QQLNSYPPFT

SEQ ID NO: 5527 - protein, 15 aa, Homo sapiens
TFSGFSLSTSGVGVG

SEQ ID NO: 5528 - protein, 16 aa, Homo sapiens
LIYWDDDKRYSPSLKS

SEQ ID NO: 5529 - protein, 11 aa, Homo sapiens
AHHSLSSIFDY

SEQ ID NO: 5530 - protein, 14 aa, Homo sapiens
TGTSSDVGDYNYVS

SEQ ID NO: 5531 - protein, 8 aa, Homo sapiens
YEVSNRPS

SEQ ID NO: 5532 - protein, 9 aa, Homo sapiens
SSYTSSSTV

SEQ ID NO: 5533 - protein, 15 aa, Homo sapiens
TVSGGSISSSSYYWG

SEQ ID NO: 5534 - protein, 16 aa, Homo sapiens
SIYYSGSTYYNPSLKS

SEQ ID NO: 5535 - protein, 18 aa, Homo sapiens
ASEKVDFWSGGPYYGMDV

SEQ ID NO: 5536 - protein, 14 aa, Homo sapiens
TGTSSDVGSYNYVS

SEQ ID NO: 5537 - protein, 8 aa, Homo sapiens
YEVSNRPS

SEQ ID NO: 5538 - protein, 10 aa, Homo sapiens
SSYTSISTLV

SEQ ID NO: 5539 - protein, 13 aa, Homo sapiens
AASGFTFSNAWMS

SEQ ID NO: 5540 - protein, 19 aa, Homo sapiens
HIKSKTDGGTTDYAAPVKG

SEQ ID NO: 5541 - protein, 9 aa, Homo sapiens
TREPYYFDY

SEQ ID NO: 5542 - protein, 11 aa, Homo sapiens
RASQSISSWLA

SEQ ID NO: 5543 - protein, 8 aa, Homo sapiens
YKASSLES

SEQ ID NO: 5544 - protein, 9 aa, Homo sapiens
QQYNSYRYT

SEQ ID NO: 5545 - protein, 13 aa, Homo sapiens
AASGLTVSSNYMS

SEQ ID NO: 5546 - protein, 16 aa, Homo sapiens
VIYSGGSTYYADSVKG

SEQ ID NO: 5547 - protein, 9 aa, Homo sapiens
ARSPYGGNS

SEQ ID NO: 5548 - protein, 11 aa, Homo sapiens
RTSQTIYNYLN

SEQ ID NO: 5549 - protein, 8 aa, Homo sapiens
YAASSFQN

SEQ ID NO: 5550 - protein, 9 aa, Homo sapiens
QQGYSTPLT

SEQ ID NO: 5551 - protein, 13 aa, Homo sapiens
KASGYTFTSYGIS

SEQ ID NO: 5552 - protein, 17 aa, Homo sapiens
WISAYNGNTNYAQKLQG

SEQ ID NO: 5553 - protein, 15 aa, Homo sapiens
ARDRGYAATFGVFDY

SEQ ID NO: 5554 - protein, 11 aa, Homo sapiens
RASQSISSYLN

SEQ ID NO: 5555 - protein, 8 aa, Homo sapiens
SAASSLQS

SEQ ID NO: 5556 - protein, 9 aa, Homo sapiens
QQSYSTAFT

SEQ ID NO: 5557 - protein, 13 aa, Homo sapiens
AASGFTFSSYAMH

SEQ ID NO: 5558 - protein, 17 aa, Homo sapiens
VISYDGSNKYYADSVKG

SEQ ID NO: 5559 - protein, 14 aa, Homo sapiens
ARPLSGSYRSAFDI

SEQ ID NO: 5560 - protein, 11 aa, Homo sapiens
RASQSVSSNLA

SEQ ID NO: 5561 - protein, 8 aa, Homo sapiens
YGASTRAT

SEQ ID NO: 5562 - protein, 10 aa, Homo sapiens
QQYNNWPPRT

SEQ ID NO: 5563 - protein, 13 aa, Homo sapiens
AASGFTFSSYAMH

SEQ ID NO: 5564 - protein, 17 aa, Homo sapiens
VISYDGSNKYYADSVKG

SEQ ID NO: 5565 - protein, 14 aa, Homo sapiens
ARASSGGYQGPFDP

SEQ ID NO: 5566 - protein, 14 aa, Homo sapiens
TGTSSDVGGYNYVS

SEQ ID NO: 5567 - protein, 8 aa, Homo sapiens
YDVSNRPS

SEQ ID NO: 5568 - protein, 12 aa, Homo sapiens
SSYTSSSTLLYV

SEQ ID NO: 5569 - protein, 13 aa, Homo sapiens
AASGFTFATYAMH

SEQ ID NO: 5570 - protein, 17 aa, Homo sapiens
LISHDGSNKHYADSVKG

SEQ ID NO: 5571 - protein, 14 aa, Homo sapiens
ARESLEAAAPPFDY

SEQ ID NO: 5572 - protein, 11 aa, Homo sapiens
SGDKLGEKYAS

SEQ ID NO: 5573 - protein, 8 aa, Homo sapiens
YQDRKRPS

SEQ ID NO: 5574 - protein, 10 aa, Homo sapiens
QAWDSSNSVV

SEQ ID NO: 5575 - protein, 445 aa, Homo sapiens
QVQLQESGPGLVKPSETLSLTCTVSGGSISSYYWSWIRQPAGKGLEWIGRIYTSGSTNYNPSLKSRVTMSVDTSKNQFSLKLSSVTAADTAVYYCAAGYGSIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5576 - protein, 219 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5577 - protein, 451 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARASGGSYFGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5578 - protein, 217 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5579 - protein, 459 aa, Homo sapiens
QLQLQESGPGLVKPSETLSLTCSVSGGSISSSSYHWGWIRQPPGKGLEWIGSIYYSGSTYYNPSLKSRVTISVDTSKNQFSLKLRSVTAADTAVYYCAGLRVVITFGGVIPKGGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5580 - protein, 216 aa, Homo sapiens
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5581 - protein, 456 aa, Homo sapiens
QVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCATTMVRGVIRLDHYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5582 - protein, 216 aa, Homo sapiens
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLLFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5583 - protein, 451 aa, Homo sapiens
QVQLVESGGGVVQPGRSLRLSCVASGFTFSSYAMHWVRQAPGKGLEWVAVISYDGSNKYYADSVKGRFTISRDNSKNTLYLQMNSLRAEDTAVYYCARDRVGGYSYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5584 - protein, 220 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5585 - protein, 451 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAGSGNYYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5586 - protein, 215 aa, Homo sapiens
EIVMTQSPATLSVSPGERATLSCRASQTVSSNLVWYQQKPGQAPRLLIYGASTRATGIPARFSGSGSGTEFTLTISSLQSEDFAVYYCQQYNNWPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5587 - protein, 456 aa, Homo sapiens
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCASEKVDFWSGGPYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5588 - protein, 216 aa, Homo sapiens
QSALTQPASVSGSPGQSITISCTGTSSDVGSYNYVSWYQQHPGKAPKLMIYEVSNRPSGVSNRFSGSKSGNTASLTISGLQAEDEADYYCSSYTSISTLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5589 - protein, 451 aa, Homo sapiens
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARPLSGSYRSAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5590 - protein, 215 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYCQQYNNWPPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5591 - protein, 451 aa, Homo sapiens
QVQLVESGGGVVQPGRSLRLSCAASGFTFATYAMHWVRQAPGKGLEWVALISHDGSNKHYADSVKGRFTISRDNSKKTLYLQMNSLRAEGTAIYYCARESLEAAAPPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5592 - protein, 213 aa, Homo sapiens
SYELTQPPSVSVSPGQTATIICSGDKLGEKYASWYQQKPGQSPALVIYQDRKRPSGIPERFSGSNSGNTATLTISGTQAMDEADYYCQAWDSSNSVVFGGGTKLTVPGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5593 - protein, 15 aa, Homo sapiens
TFSGFSLSTNGVGMG

SEQ ID NO: 5594 - protein, 16 aa, Homo sapiens
LIYWDDDQFYSPSLKS

SEQ ID NO: 5595 - protein, 12 aa, Homo sapiens
AQAFYESFGFYS

SEQ ID NO: 5596 - protein, 13 aa, Homo sapiens
TRSIGSIASNYVQ

SEQ ID NO: 5597 - protein, 8 aa, Homo sapiens
FEDNERPS

SEQ ID NO: 5598 - protein, 10 aa, Homo sapiens
QSYDGSSELV

SEQ ID NO: 5599 - protein, 13 aa, Homo sapiens
KVSGYTLPELSIH

SEQ ID NO: 5600 - protein, 17 aa, Homo sapiens
GFDPENAETIYTQKFQG

SEQ ID NO: 5601 - protein, 22 aa, Homo sapiens
ATSFVLMPAALGDYSYYYGMDV

SEQ ID NO: 5602 - protein, 16 aa, Homo sapiens
RSSQSLVHSDGNTYLS

SEQ ID NO: 5603 - protein, 8 aa, Homo sapiens
YKISNRFS

SEQ ID NO: 5604 - protein, 9 aa, Homo sapiens
MQATQFPLT

SEQ ID NO: 5605 - protein, 13 aa, Homo sapiens
AASGFTFDDYAMH

SEQ ID NO: 5606 - protein, 17 aa, Homo sapiens
LISGDGGSTYYADSVKG

SEQ ID NO: 5607 - protein, 20 aa, Homo sapiens
VKDRGGSGWDLNHYYYGMDV

SEQ ID NO: 5608 - protein, 11 aa, Homo sapiens
RASQGISSYLA

SEQ ID NO: 5609 - protein, 8 aa, Homo sapiens
YAAYTLQS

SEQ ID NO: 5610 - protein, 9 aa, Homo sapiens
QQVKSYPLT

SEQ ID NO: 5611 - protein, 13 aa, Homo sapiens
AASGFIFDDYDMT

SEQ ID NO: 5612 - protein, 17 aa, Homo sapiens
GISWNGGNTGYADSVKG

SEQ ID NO: 5613 - protein, 22 aa, Homo sapiens
AVIMSPIPRYSGYDWAGGAFDI

SEQ ID NO: 5614 - protein, 11 aa, Homo sapiens
QGDSLRSYYAS

SEQ ID NO: 5615 - protein, 8 aa, Homo sapiens
YDKNNRPS

SEQ ID NO: 5616 - protein, 11 aa, Homo sapiens
NSRDSSGNAVV

SEQ ID NO: 5617 - protein, 13 aa, Homo sapiens
AGSGFTFDDYAMH

SEQ ID NO: 5618 - protein, 17 aa, Homo sapiens
GISWNSGSIGYADSVKG

SEQ ID NO: 5619 - protein, 18 aa, Homo sapiens
AKDVSYDSSGYYNNAFDI

SEQ ID NO: 5620 - protein, 11 aa, Homo sapiens
RASQGISSYLA

SEQ ID NO: 5621 - protein, 8 aa, Homo sapiens
YAASTLQS

SEQ ID NO: 5622 - protein, 9 aa, Homo sapiens
QQLYSYPVT

SEQ ID NO: 5623 - protein, 13 aa, Homo sapiens
AASGFTFSSYWMS

SEQ ID NO: 5624 - protein, 17 aa, Homo sapiens
NINKDGSEKYYVDSVKG

SEQ ID NO: 5625 - protein, 23 aa, Homo sapiens
ARDYRYFDWLLSQIDLEIDYFDY

SEQ ID NO: 5626 - protein, 11 aa, Homo sapiens
RASQSISSYLN

SEQ ID NO: 5627 - protein, 8 aa, Homo sapiens
YAASSLQS

SEQ ID NO: 5628 - protein, 9 aa, Homo sapiens
QQSYSTPLT

SEQ ID NO: 5629 - protein, 13 aa, Homo sapiens
AASGFTFSSYWMH

SEQ ID NO: 5630 - protein, 17 aa, Homo sapiens
HINSDGSSTSYADSVKG

SEQ ID NO: 5631 - protein, 11 aa, Homo sapiens
ARGLRYFDLDV

SEQ ID NO: 5632 - protein, 13 aa, Homo sapiens
SGSSSNIGNNAVN

SEQ ID NO: 5633 - protein, 8 aa, Homo sapiens
FYDDLLPS

SEQ ID NO: 5634 - protein, 11 aa, Homo sapiens
AAWDDSLNGGV

SEQ ID NO: 5635 - protein, 13 aa, Homo sapiens
KASGGTLSSYTIS

SEQ ID NO: 5636 - protein, 17 aa, Homo sapiens
RIIPILGIADYAQKFQG

SEQ ID NO: 5637 - protein, 19 aa, Homo sapiens
ASAPKDWSSGFDYYYGMDV

SEQ ID NO: 5638 - protein, 16 aa, Homo sapiens
KSSQSLLNSDGKTYLY

SEQ ID NO: 5639 - protein, 8 aa, Homo sapiens
YEVSNRFS

SEQ ID NO: 5640 - protein, 10 aa, Homo sapiens
MQSVQLPPYT

SEQ ID NO: 5641 - protein, 15 aa, Homo sapiens
TFSGFSLSTSGVGVG

SEQ ID NO: 5642 - protein, 16 aa, Homo sapiens
LIYWDDDKRYSPSLKS

SEQ ID NO: 5643 - protein, 11 aa, Homo sapiens
AHHTITRINDY

SEQ ID NO: 5644 - protein, 14 aa, Homo sapiens
TATSSDVGAYNYVS

SEQ ID NO: 5645 - protein, 8 aa, Homo sapiens
YDVSKRPS

SEQ ID NO: 5646 - protein, 9 aa, Homo sapiens
SSYTSSSTV

SEQ ID NO: 5647 - protein, 13 aa, Homo sapiens
KVSGYTLIELSMH

SEQ ID NO: 5648 - protein, 17 aa, Homo sapiens
GFDPEDGETIYAQKFQG

SEQ ID NO: 5649 - protein, 15 aa, Homo sapiens
ATEWAYYGSGSYLGY

SEQ ID NO: 5650 - protein, 11 aa, Homo sapiens
RASQSVSSNLA

SEQ ID NO: 5651 - protein, 8 aa, Homo sapiens
YGASTRVT

SEQ ID NO: 5652 - protein, 9 aa, Homo sapiens
QQYNNWPRT

SEQ ID NO: 5653 - protein, 13 aa, Homo sapiens
KASGGTFSSNTIS

SEQ ID NO: 5654 - protein, 17 aa, Homo sapiens
RIIPLLGTVNYAQKFQG

SEQ ID NO: 5655 - protein, 21 aa, Homo sapiens
ARDAGGITIFGVEHYYYYMDV

SEQ ID NO: 5656 - protein, 12 aa, Homo sapiens
RASQSVSSSHLA

SEQ ID NO: 5657 - protein, 8 aa, Homo sapiens
YDASSRAT

SEQ ID NO: 5658 - protein, 12 aa, Homo sapiens
QQYGSSPPMYTF

SEQ ID NO: 5659 - protein, 13 aa, Homo sapiens
AASGLTFEDYAMH

SEQ ID NO: 5660 - protein, 17 aa, Homo sapiens
GISWNSGTIGYADSVKG

SEQ ID NO: 5661 - protein, 16 aa, Homo sapiens
AKDVGFGELLYYAFDI

SEQ ID NO: 5662 - protein, 14 aa, Homo sapiens
TGTSSDVGGYNYVS

SEQ ID NO: 5663 - protein, 8 aa, Homo sapiens
YDVSNRPS

SEQ ID NO: 5664 - protein, 10 aa, Homo sapiens
SSYTSSSTVV

SEQ ID NO: 5665 - protein, 13 aa, Homo sapiens
KASGYTFSSYEIN

SEQ ID NO: 5666 - protein, 17 aa, Homo sapiens
RMTLNSGNTGYAQNFQG

SEQ ID NO: 5667 - protein, 16 aa, Homo sapiens
ARMRSGWPTHGRPDDY

SEQ ID NO: 5668 - protein, 13 aa, Homo sapiens
SGSNSNIGSYTVN

SEQ ID NO: 5669 - protein, 8 aa, Homo sapiens
YGNNQRPS

SEQ ID NO: 5670 - protein, 11 aa, Homo sapiens
LAWDDSRNGLV

SEQ ID NO: 5671 - protein, 13 aa, Homo sapiens
KASGYTFASYDIN

SEQ ID NO: 5672 - protein, 17 aa, Homo sapiens
WMIPNIGNTGYAQKFQG

SEQ ID NO: 5673 - protein, 20 aa, Homo sapiens
ARVSRLFNDFGLRHEAPVDF

SEQ ID NO: 5674 - protein, 14 aa, Homo sapiens
TGSSSNIGAGYDVH

SEQ ID NO: 5675 - protein, 8 aa, Homo sapiens
YGYSSRPS

SEQ ID NO: 5676 - protein, 10 aa, Homo sapiens
QSYDSSLSVL

SEQ ID NO: 5677 - protein, 14 aa, Homo sapiens
TFSGFSLSISGVGV

SEQ ID NO: 5678 - protein, 16 aa, Homo sapiens
LIYWDDDKRYSPSLKS

SEQ ID NO: 5679 - protein, 10 aa, Homo sapiens
AHSISTIFDH

SEQ ID NO: 5680 - protein, 14 aa, Homo sapiens
TATSSDVGDYNYVS

SEQ ID NO: 5681 - protein, 8 aa, Homo sapiens
FEVSDRPS

SEQ ID NO: 5682 - protein, 9 aa, Homo sapiens
SSYTTSSAV

SEQ ID NO: 5683 - protein, 13 aa, Homo sapiens
KASGYTFTAYYMH

SEQ ID NO: 5684 - protein, 17 aa, Homo sapiens
WINPNSDDTNYAQKFQG

SEQ ID NO: 5685 - protein, 16 aa, Homo sapiens
AREEGVFTIGDRYFDL

SEQ ID NO: 5686 - protein, 14 aa, Homo sapiens
GLSSGSVSTSYYPS

SEQ ID NO: 5687 - protein, 8 aa, Homo sapiens
YNTNTRSS

SEQ ID NO: 5688 - protein, 10 aa, Homo sapiens
VLYMGSGIWV

SEQ ID NO: 5689 - protein, 13 aa, Homo sapiens
TASGFTFSSYAMH

SEQ ID NO: 5690 - protein, 17 aa, Homo sapiens
VISYDGNNKYYGDSVKG

SEQ ID NO: 5691 - protein, 26 aa, Homo sapiens
AKGADTPHYSGYHFLSVGYYFYGMDV

SEQ ID NO: 5692 - protein, 11 aa, Homo sapiens
RASQSISYYLN

SEQ ID NO: 5693 - protein, 8 aa, Homo sapiens
YAASSLQS

SEQ ID NO: 5694 - protein, 9 aa, Homo sapiens
QQSYSTPFT

SEQ ID NO: 5695 - protein, 13 aa, Homo sapiens
AASGFTFSSYAMS

SEQ ID NO: 5696 - protein, 17 aa, Homo sapiens
GISDSGGSTYYADYVKG

SEQ ID NO: 5697 - protein, 20 aa, Homo sapiens
AKDRGNEYALTHYYYYAMDV

SEQ ID NO: 5698 - protein, 11 aa, Homo sapiens
RASQSISSYLN

SEQ ID NO: 5699 - protein, 12 aa, Homo sapiens
YAAYSLQSGVPS

SEQ ID NO: 5700 - protein, 9 aa, Homo sapiens
QQSYSTPIT

SEQ ID NO: 5701 - protein, 13 aa, Homo sapiens
AASGFTFSRFTLH

SEQ ID NO: 5702 - protein, 17 aa, Homo sapiens
VISYDGSNKYYADSVKG

SEQ ID NO: 5703 - protein, 13 aa, Homo sapiens
ARDPSTVTGYFDY

SEQ ID NO: 5704 - protein, 11 aa, Homo sapiens
GGDSIGSKSVH

SEQ ID NO: 5705 - protein, 8 aa, Homo sapiens
YYDNDRPS

SEQ ID NO: 5706 - protein, 8 aa, Homo sapiens
QVWDIGVV

SEQ ID NO: 5707 - protein, 450 aa, Homo sapiens
QITLKESGPTLVKPTQTLTLTCTFSGFSLSTNGVGMGWIRQPPGKALEWLALIYWDDDQFYSPSLKSRLTITRDTSKNQVVLTMTNMDPVDTATYYCAQAFYESFGFYSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5708 - protein, 217 aa, Homo sapiens
NFMLTQPHSVSESPGKTVIISCTRSIGSIASNYVQWYQQRPGSAPTIVVFEDNERPSGVPDRFSGSIDRSSNSASLTISGLKTEDEADYYCQSYDGSSELVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5709 - protein, 459 aa, Homo sapiens
QVQLVQSGAEVKKPGASVKVSCKVSGYTLPELSIHWVRQAPGKGLEWMGGFDPENAETIYTQKFQGRLTMTEDTSTDTAYMELSSLRSEDTAMYYCATSFVLMPAALGDYSYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5710 - protein, 219 aa, Homo sapiens
DIVMTQTPLSSPVTLGQPASISCRSSQSLVHSDGNTYLSWLQQRPGQPPRLLIYKISNRFSGVPDRFSGSGAGTDFTLKISRVEAEDVGVYYCMQATQFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5711 - protein, 457 aa, Homo sapiens
EVQLVESGGGVVQPGGSLRLSCAASGFTFDDYAMHWVRQVPGKGLEWVSLISGDGGSTYYADSVKGRFTISRDNSKNSLYVQMNSLRTEDTALYYCVKDRGGSGWDLNHYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5712 - protein, 214 aa, Homo sapiens
DIQLTQSPSFLSASVGDRVTVTCRASQGISSYLAWYQQKPGKAPKLLIYAAYTLQSGVPSRFSGSGSETEFTLTISSLQPEDFATYYCQQVKSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5713 - protein, 459 aa, Homo sapiens
EVQLVESGGGVVRPGGSLRLSCAASGFIFDDYDMTWVRQAPGKGLEWVSGISWNGGNTGYADSVKGRFTISRDNAKNSLYLQMNSLRAEDTALYHCAVIMSPIPRYSGYDWAGGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5714 - protein, 214 aa, Homo sapiens
SSELTQDPAVSVALGQTVRITCQGDSLRSYYASWYQQKPGQVPILVIYDKNNRPSGIPDRFSGSSSGNTASLTITGAQAEDEADYYCNSRDSSGNAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5715 - protein, 455 aa, Homo sapiens
EVQLVESGGGLVQPGRSLTLSCAGSGFTFDDYAMHWVRQAPGKGLEWVSGISWNSGSIGYADSVKGRFTISRDNAKNSLYLQMNSLRAEDTALYYCAKDVSYDSSGYYNNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5716 - protein, 214 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLYSYPVTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5717 - protein, 460 aa, Homo sapiens
EVQLVESGGGLVQPGGSLRLSCAASGFTFSSYWMSWVRQAPGKGLEWVANINKDGSEKYYVDSVKGRFTISRDNAKNSLYLQMNSLRAEDTAVYFCARDYRYFDWLLSQIDLEIDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5718 - protein, 214 aa, Homo sapiens
DIQMTQSPSSLSASVGDRVTITCRASQSISSYLNWYQQKPGKAPKVLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5719 - protein, 448 aa, Homo sapiens
EVQLVESGGGLVQPGGSLRLSCAASGFTFSSYWMHWVRQAPGKGLVWVSHINSDGSSTSYADSVKGRFTISRDNAKNTLYLQMNSLRAEDTAVYYCARGLRYFDLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5720 - protein, 216 aa, Homo sapiens
QSVLTQPPSVSEAPRQRVTISCSGSSSNIGNNAVNWYQQLPGKAPKLLIFYDDLLPSGVSDRFSGSKSGTSASLAISGLQSEDEADYYCAAWDDSLNGGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5721 - protein, 456 aa, Homo sapiens
QVQLVQSGAEVKKPGSSVKVSCKASGGTLSSYTISWVRQAPGQGLEWMGRIIPILGIADYAQKFQGRVTITADKSTTTAYMDLSSLGSEDTALYYCASAPKDWSSGFDYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5722 - protein, 220 aa, Homo sapiens
DIVMTQTPLSLSVTPGQPASISCKSSQSLLNSDGKTYLYWYLQKAGQPPQLLIYEVSNRFSGVPERFSGSGSGTDFTLKISRVEAEDVGVYYCMQSVQLPPYTFGQGTKLEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5723 - protein, 449 aa, Homo sapiens
QITLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHHTITRINDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5724 - protein, 215 aa, Homo sapiens
QSALTQPASVSGSPGQSITISCTATSSDVGAYNYVSWYQQHPGKAPKLMIYDVSKRPSGVSNRFSGSKSGNTASLTISGLQAEDEADYYCSSYTSSSTVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5725 - protein, 452 aa, Homo sapiens
QVQLVQSGAEVKKPGASVKVSCKVSGYTLIELSMHWVRQAPGKGLEWMGGFDPEDGETIYAQKFQGRVTMTEDTSTDTAYMELSSLRSEDTAVYYCATEWAYYGSGSYLGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5726 - protein, 214 aa, Homo sapiens
EIVMTQSPATLSVSPGERATLSCRASQSVSSNLAWFQQKPGQAPRLLIYGASTRVTVIPARFSGSGSGTEFTLTISSLQSEDFAVYYCQQYNNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5727 - protein, 458 aa, Homo sapiens
QVQLVQSGAEVKKPGSSVKVSCKASGGTFSSNTISWVRQAPGQGLEWMGRIIPLLGTVNYAQKFQGRVTITADKSTTTAYMELSSLRSEDTAVYYCARDAGGITIFGVEHYYYYMDVWGKGTTVTVTSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5728 - protein, 217 aa, Homo sapiens
EIVLTQSPGTLSLSPGERATLSCRASQSVSSSHLAWYQQKPGQAPRLLIYDASSRATGIPDRFSGSGSGTDFTLTISRLEPEDFAVYYCQQYGSSPPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5729 - protein, 453 aa, Homo sapiens
EVQLVESGGGLVQPGRSLRLSCAASGLTFEDYAMHWVRQVPGKGLEWVSGISWNSGTIGYADSVKGRFIISRDNAKNSLYLQMRSLRAEDTALYYCAKDVGFGELLYYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5730 - protein, 216 aa, Homo sapiens; identical to SEQ ID NO: 5580

SEQ ID NO: 5731 - protein, 453 aa, Homo sapiens
QVQLVQSGAEVKKPGASVKVSCKASGYTFSSYEINWVRQATGQGLEWMGRMTLNSGNTGYAQNFQGRVTMTRDTSISTAYMELSGLRSEDTAVYYCARMRSGWPTHGRPDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5732 - protein, 216 aa, Homo sapiens
QSVLTQPPSASGTPGQRVTISCSGSNSNIGSYTVNWYQQLPGTAPKLLIYGNNQRPSGVPDRFSGSKSGTSASLAISGLQSEDEADYYCLAWDDSRNGLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5733 - protein, 458 aa, Homo sapiens
HQVQLVQSGAEVKKPGASVKVSCKASGYTFASYDINWVRQATGQGPEWMGWMIPNIGNTGYAQKFQGRVTMTRNTSISTAYMELSSLTSEDTAVYYCARVSRLFNDFGLRHEAPVDFWGQGTRVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5734 - protein, 216 aa, Homo sapiens
QSVLTQPPSVSGAPGQRVTISCTGSSSNIGAGYDVHWYQQLPGTAPKLLIYGYSSRPSGVPDRFSGSKSGTSASLAITGLQAEDEADYYCQSYDSSLSVLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5735 - protein, 449 aa, Homo sapiens
QITLKESGPTLVKPTQTLTLTCTFSGFSLSISGVGVGWLRQPPGKALEWLALIYWDDDKRYSPSLKSRLTISKDTSKNQVVLKMTNIDPVDTATYYCAHHSISTIFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5736 - protein, 215 aa, Homo sapiens
QSALTQPASVSGSPGQSITISCTATSSDVGDYNYVSWYQQHPGKAPKLMIFEVSDRPSGISNRFSGSKSGNTASLTISGLQAEDEADYYCSSYTTSSAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5737 - protein, 453 aa, Homo sapiens
QVQLVQSGAEVKKPGASVKVSCKASGYTFTAYYMHWVRQAPGQGLEWMGWINPNSDDTNYAQKFQGRVTMTRDTSISTAYMELSRLRSDDTAVYYCAREEGVFTIGDRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5738 - protein, 216 aa, Homo sapiens
QTVVTQEPSFSVSPGGTVTLTCGLSSGSVSTSYYPSWYQQTPGQAPRTLIYNTNTRSSGVPDRFSGSILGNKAALTITGAQADDESDYYCVLYMGSGIWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5739 - protein, 463 aa, Homo sapiens
QVQLVESGGGVVQPGRSLRLSCTASGFTFSSYAMHWVRQAPGKGLEWVAVISYDGNNKYYGDSVKGRFTISRDNSKNTLYLQMNSLRAEDTAVYYCAKGADTPHYSGYHFLSVGYYFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5740 - protein, 214 aa, Homo sapiens
DIQMTQSPSSLSASVGDRVTITCRASQSISYYLNWYQQKPGKAPQLLIYAASSLQSGVPSRFSGSRSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5741 - protein, 457 aa, Homo sapiens
EVQLLESGGGLVQPGGSLRLSCAASGFTFSSYAMSWVRQAPGKGLEWVSGISDSGGSTYYADYVKGRFTISRDNSKDTLYLQMNSLRAEDTAVYYCAKDRGNEYALTHYYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5742 - protein, 214 aa, Homo sapiens
DIQMTQSPSSLSASVGDRVTITCRASQSISSYLNWYQQKPGKAPKLLIYAAYSLQSGVPSRFSGGGSGTDFTLTISSLQPEDFATYFCQQSYSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5743 - protein, 450 aa, Homo sapiens
QVQLVESGGGVVQPGRSLRLSCAASGFTFSRFTLHWVRQAPGKGLEWVAVISYDGSNKYYADSVKGRFTISRDNSKSTLYLQMNSLRAEDTGVYYCARDPSTVTGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5744 - protein, 211 aa, Homo sapiens
SYVLTQPPSVSVAPGKTAKISCGGDSIGSKSVHWYQQKPGQAPVLVIYYDNDRPSGIPERFSGSNSGNTATLTISRVEAGDEADYYCQVWDIGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5745 - DNA, 1350 bp, Homo sapiens
cagatcaccttgaaggagtctggtcctacgctggtgaaacccacacagaccctcacgctgacctgcaccttctctgggttctcactcagcactaatggagtgggtatgggctggatccgtcagcccccaggaaaggccctggagtggcttgcactcatttattgggatgatgatcagttctacagcccatctctgaagagcaggctcaccatcaccagggacacctccaaaaaccaggtggtccttacaatgaccaacatggaccctgtggacacagccacatattactgtgcacaagccttctatgagagtttcggtttttactcctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5746 - DNA, 651 bp, Homo sapiens
aattttatgctgactcagccgcactctgtgtcggagtctccggggaagacggtaatcatctcctgcacccgcagcattggcagcattgccagcaactatgtgcagtggtaccagcagcgcccgggcagtgcccccaccattgtggtctttgaggataacgagagaccctctggggtccctgatcggttctctggctccatcgaccgctcctccaactctgcctccctcaccatctctggactgaagactgaggacgaggctgactactactgtcagtcttatgatggctccagtgaattggtattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5747 - DNA, 1377 bp, Homo sapiens
caggtccagctggtacagtctggggctgaggtgaagaagcctggggcctcagtgaaggtctcctgcaaggtttccggatacaccctccctgaattatccatacactgggtgcgacaggctcctggaaaagggcttgagtggatgggaggttttgatcctgaaaatgctgaaacaatctacacacagaagttccagggcagactcaccatgaccgaggacacatctacagacacagcctacatggagctgagcagcctgagatctgaggacacggccatgtattactgtgcaacaagttttgtactaatgccggctgctctgggggattactcctactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5748 - DNA, 657 bp, Homo sapiens
gatattgtgatgacccagactccactctcctcacctgtcacccttggacagccggcctccatctcctgcaggtctagtcaaagcctcgtacacagtgatggaaacacctacttgagttggcttcagcagaggccaggccagcctccaagactcctaatttataagatttctaaccggttctctggggtcccagacagattcagtggcagtggggcagggacagatttcacactgaaaatcagcagggtggaagctgaggatgtcggggtttattactgcatgcaagctacacaatttcctctcactttcggcggagggaccaaggtggagatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5749 - DNA, 1371 bp, Homo sapiens
gaagtgcagctggtggagtctgggggaggcgtggtacagcctggggggtccctgagactctcctgtgcagcctctggattcacctttgatgattatgccatgcactgggtccgtcaagttccagggaagggtctggagtgggtctctcttattagtggggatggtggtagcacatactatgcagactctgtgaagggccgattcaccatctccagagacaacagcaaaaactccctgtatgtgcaaatgaacagtctgagaactgaggacaccgccttgtattactgtgtaaaagatagagggggcagtggctgggacctcaaccactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5750 - DNA, 642 bp, Homo sapiens
gacatccagttgacccagtctccatccttcctgtctgcatctgtaggagacagagtcaccgtcacttgccgggccagtcagggcattagcagttatttagcctggtatcagcaaaaaccagggaaagcccctaagctcctcatctatgctgcatacactttgcaaagtggggtcccatcaaggttcagcggcagtggatctgagacagaattcactctcacaatcagcagcctgcagcctgaagattttgcaacttattactgtcaacaggttaagagttaccctctcactttcggcggagggaccaaggtggagatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5751 - DNA, 1377 bp, Homo sapiens
gaggtgcagctggtggagtctgggggaggtgtggtacggcctggggggtccctgagactctcctgtgcagcctctggattcatctttgatgattatgacatgacctgggtccgccaagctccagggaaggggctggagtgggtctctggtattagttggaatggtggtaacacaggttatgcagactctgtgaagggccgattcaccatctccagagacaacgccaagaactccctgtatctgcaaatgaacagtctgagagccgaggacacggccttgtatcactgtgcagtgattatgtctccaatcccccgttatagtggctacgattgggcgggtggtgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5752 - DNA, 642 bp, Homo sapiens
tcttctgagctgactcaggaccctgctgtgtctgtggccttgggacagacagtcaggatcacatgccaaggagacagcctcagaagctattatgcaagctggtaccagcagaagccaggacaggtccctatacttgtcatctatgataaaaacaaccggccctcagggatcccagaccgattctctggctccagctcaggaaacacagcttccttgaccatcactggggctcaggcggaagatgaggctgactattactgtaactcccgggacagcagtggtaacgccgtggtgttcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5753 - DNA, 1365 bp, Homo sapiens
gaagtgcagctggtggagtctgggggaggcttggtacagcctggcaggtccctgacactctcctgtgcaggctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactccctatatctgcaaatgaacagtctgagagctgaggacacggccttgtattactgtgcaaaagatgtctcctatgatagtagtggttattacaacaatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5754 - DNA, 642 bp, Homo sapiens
gacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatgctgcatccactttgcaaagtggggtcccatcaaggttcagcggcagtggatctgggacagaattcactctcacaataagcagcctgcagcctgaagattttgcaacttattactgtcaacaactttatagttacccggtcaccttcggccaagggacacgactggagattaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5755 - DNA, 1380 bp, Homo sapiens
gaggtgcagctggtggagtctgggggaggcttggtccagcctggggggtccctgagactctcctgtgcagcctctggattcacctttagtagttattggatgagctgggtccgccaggctccagggaaggggctggagtgggtggccaacataaacaaagatggaagtgagaaatactatgtggactctgtgaagggccgattcaccatctccagagacaacgccaagaactcactgtatctgcaaatgaacagcctgcgagccgaggacacggctgtgtatttctgtgcgagagattatcgatattttgactggttattatcgcaaatagacttggagattgactactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5756 - DNA, 642 bp, Homo sapiens
gacatccagatgacccagtctccatcctccctgtctgcatctgtaggagacagagtcaccatcacttgccgggcaagtcagagcattagcagttatttaaattggtatcagcagaaaccagggaaagcccctaaggtcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctctcactttcggcggagggaccaaggtggagatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5757 - DNA, 1344 bp, Homo sapiens
gaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacatattaatagtgatgggagtagcacgagctacgcggactccgtgaagggccgattcaccatctccagagacaacgccaagaacacgctgtatctgcaaatgaacagtctgagagccgaggacacggctgtgtattactgtgcaagaggcttacgatattttgacctggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5758 - DNA, 648 bp, Homo sapiens
cagtctgtgctgactcagccaccctcggtgtctgaagcccccaggcagagggtcaccatctcctgttctggaagcagctccaacatcggaaataatgctgtgaactggtaccagcagctcccaggaaaggctcccaaactcctcatcttttatgatgatctgctgccctcaggggtctctgaccgattctctggctccaagtctggcacctcagcctccctggccatcagtgggctccagtctgaggatgaggctgattattactgtgcagcatgggatgacagcctgaatggtggggtgttcggcggagggaccaaactgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5759 - DNA, 1368 bp, Homo sapiens
caggtccagctggtgcagtctggggctgaggtgaagaagcctgggtcctcggtgaaggtctcctgcaaggcttctggaggcaccttgagcagctatactatcagctgggtgcgacaggcccctggacaagggcttgagtggatgggaaggatcatccctatccttggtatagcagactacgcacagaagttccagggcagagtcacgattaccgcggacaaatccacgaccacagcctacatggatctgagcagcctgggatctgaggacacggccttgtattattgtgcgagtgctccgaaggattggagctccggttttgactactactacggtatggacgtctggggccaagggaccatggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5760 - DNA, 660 bp, Homo sapiens
gatattgtgatgacccagactccactctctctgtccgtcacccctggacagccggcctccatctcctgcaagtctagtcagagcctcctgaatagtgatggaaagacctatttgtattggtacctgcagaaggcaggccagcctccacagctcctgatctatgaagtttccaaccggttctctggagtgccagaaaggttcagtggcagcgggtcagggacagatttcacactgaaaatcagccgggtggaggctgaggatgttggggtttactactgcatgcaaagtgtacaacttcctccgtacacttttggccagggcaccaagctggagatcacaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5761 - DNA, 1347 bp, Homo sapiens
cagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacaccatacgataactcggataaatgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5762 - DNA, 645 bp, Homo sapiens
cagtctgccctgactcagcctgcctccgtgtctgggtctcctggacagtcgatcaccatctcctgcactgcaaccagcagtgacgttggtgcttataactatgtctcctggtaccaacaacacccaggcaaagcccccaaactcatgatttatgatgtcagtaagcggccctcaggggtttctaatcgcttctctggctccaagtctggcaacacggcctccctgaccatctctgggctccaggctgaggacgaggctgattattactgcagctcatacacaagcagcagcacggtgttcggcggagggaccaagttgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5763 - DNA, 1356 bp, Homo sapiens
caggtccagctggtacagtctggggctgaggtgaagaagcctggggcctcagtgaaggtctcctgcaaggtttccggatacaccctcattgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacagagtgggcctactatggttcggggagttatttgggttactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5764 - DNA, 642 bp, Homo sapiens
gaaatagtgatgacgcagtctccagccaccctgtctgtgtctccaggggaaagagccaccctctcctgcagggccagtcagagtgttagcagcaacttagcctggttccagcagaaacctggccaggctcccaggctcctcatctatggtgcatccaccagggtcactgttatcccagccaggttcagtggcagtgggtctgggacagagttcactctcaccatcagcagcctgcagtctgaagattttgcagtttattactgtcagcagtataataactggcctcggacgttcggccaagggaccaaggtggaaatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5765 - DNA, 1374 bp, Homo sapiens
caggtccagctggtgcaatctggggctgaggtgaagaagcctgggtcctcggtgaaggtctcctgcaaggcttctggaggcaccttcagcagtaatactatcagctgggtgcgacaggcccctggacaagggcttgagtggatgggaaggatcatccctctccttggcacagtaaactacgcacagaagttccagggcagagtcacgattaccgcggacaaatccacgaccacagcctacatggagctgagcagcctgagatctgaggacacggccgtgtattactgtgcgagagatgctgggggtattacgatttttggagtggaacactactactactacatggacgtctggggcaaagggaccacggtcaccgtcacgtcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5766 - DNA, 651 bp, Homo sapiens
gaaattgtgttgacgcagtctccaggcaccctgtctttgtctccaggggaaagagccaccctctcctgcagggccagtcagagtgttagcagcagccacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctccgatgtacacttttggccaggggaccaagctggagatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5767 - DNA, 1359 bp, Homo sapiens
gaagtgcagctggtggagtctgggggaggcttggtacagcctggcaggtccctgagactctcctgtgcagcctctggactcacctttgaggattatgccatgcactgggtccggcaagttccagggaagggcctggagtgggtctcaggtattagttggaatagtggtaccataggctatgcggactctgtgaagggccgattcatcatctccagagacaacgccaagaactccctgtatctgcaaatgagaagtctgagagctgaggacacggccttgtattactgtgcaaaagatgtggggttcggggagttattatactatgcttttgatatctggggccaagggacaatggtcaccgtctcttcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5768 - DNA, 648 bp, Homo sapiens
cagtctgccctgactcagcctgcctccgtgtccgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactgtggtattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5769 - DNA, 1359 bp, Homo sapiens
caggtgcagctggtgcagtctggggctgaggtgaagaagcctggggcctcagtgaaggtctcctgcaaggcttctggatacaccttcagcagttatgaaatcaattgggtgcgacaggccactggacaagggcttgagtggatgggacggatgactcttaacagtggtaacacaggctatgcacagaacttccagggcagagtcactatgaccagggacacctccataagcacagcctacatggagctgagcggcctgagatctgaggacacggccgtgtattactgtgcgagaatgcgcagtggctggcccacacatggccgcccggatgactactggggccaaggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5770 - DNA, 648 bp, Homo sapiens
cagtctgtgctgactcagccaccctcagcgtctgggacccccgggcagagggtcaccatctcttgttctggaagtaactccaatatcggaagttatactgtaaactggtaccagcaactcccaggaacggcccccaaactgctcatctatggtaataatcagcggccctcaggggtccctgaccgattctctggctccaagtctgggacctcagcctccctggccatcagtggcctccagtctgaggatgaggctgattattactgtttggcatgggatgacagccggaatggcctggtattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5771 - DNA, 1371 bp, Homo sapiens
caggtgcagctggtgcagtctggggctgaggtgaagaagcctggggcctcagtgaaggtctcctgcaaggcttctggatacaccttcgccagttatgatatcaactgggtgcgacaggccactggacaagggcctgagtggatgggatggatgatccctaacattggtaacacaggctatgcacagaagttccagggcagagtcaccatgaccaggaacacctccataagcacagcctacatggagctgagcagcctgacatctgaggacacggccgtgtattactgtgcgagagtttctaggctatttaatgacttcggtctaagacatgaggcacccgttgacttctggggccagggaacccgggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5772 - DNA, 648 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggttacagcagtcggccctcaggggtccctgaccgattctctggctccaagtctggcacctcagcctccctggccatcactgggctccaggctgaggatgaggctgattattactgccagtcctatgacagcagcctgagtgttttattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5773 - DNA, 1347 bp, Homo sapiens
cagatcaccttgaaggagtctggtcctacgctggtgaaacccacacagaccctcacgctgacctgcaccttctctgggttctcactcagcattagtggagtgggtgtgggctggctccgtcagcccccaggaaaggccctggagtggcttgcactcatttattgggatgatgataagcgctacagcccatctctgaagagcaggctcaccatcagcaaggacacctccaaaaaccaggtggtccttaaaatgaccaacattgaccctgtggacacagccacatattactgtgcacaccattcgattagcaccatctttgaccactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5774 - DNA, 645 bp, Homo sapiens
cagtctgccctgactcagcctgcctccgtgtctgggtctcctggacagtcgatcaccatctcctgcactgcaaccagcagtgacgttggtgattataactatgtctcctggtaccaacaacacccaggcaaagcccccaaactcatgatttttgaggtcagtgatcggccctcggggatttctaatcgcttctctggctccaagtctggcaacacggcctccctgaccatctctgggctccaggctgaggacgaggctgattattactgcagctcatatacaaccagcagcgctgtattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5775 - DNA, 1359 bp, Homo sapiens
caggtgcagctggtgcagtctggggctgaggtgaagaagcctggggcctcagtgaaggtctcctgcaaggcttctggatacaccttcaccgcctactatatgcactgggtgcgacaggcccctggacaagggcttgagtggatgggctggatcaaccctaacagtgatgacacaaactatgcacagaagtttcagggcagggtcaccatgaccagggacacgtccatcagtacagcctacatggagctgagcaggctgagatctgacgacacggccgtctattactgtgcgagggaagagggagtcttcacaatcggggaccgatacttcgatctatggggccgtggcaccctggtcagtgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5776 - DNA, 648 bp, Homo sapiens
cagactgtggtgacccaggagccatcgttctcagtgtcccctggagggacagtcactctcacttgtggcttgagctctggctcagtctctactagttactaccccagctggtaccagcagaccccaggccaggctccacgcacgctcatctacaacacaaacactcgctcttctggggtccctgatcgcttctctggctccatccttgggaacaaagctgccctcaccatcacgggggcccaggcagatgatgaatctgattattactgtgtgctttatatgggtagtggcatttgggtgttcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 5777 - DNA, 1389 bp, Homo sapiens
caggtgcagctggtggagtctgggggaggcgtggtccagcctgggaggtccctgagactctcctgtacagcctctggattcaccttcagtagctatgctatgcactgggtccgccaggctccaggcaaggggctggagtgggtggcggttatatcgtatgatggaaataataaatattatggagactctgtgaagggccgattcaccatctccagagacaattccaagaacaccctgtatctgcagatgaacagcctgagagctgaggacacggctgtgtattactgcgcgaaaggtgccgacaccccccattatagtggctatcattttttgtctgtcggctactacttctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5778 - DNA, 642 bp, Homo sapiens
gacatccagatgacccagtctccatcctccctgtctgcatctgtaggagacagagtcaccatcacttgccgggcaagtcagagcattagctactatttaaattggtatcagcagaaaccagggaaagcccctcagctcctgatctatgctgcatccagtttgcaaagtggggtcccatcaaggttcagtggcagtagatctgggacagatttcactctcaccatcagcagtctgcaacctgaagactttgcaacttattactgtcaacagagttacagtactccattcactttcggccctgggaccaaagtcgatatcaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5779 - DNA, 1371 bp, Homo sapiens
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcaggtattagtgatagtggtggtagcacatactacgcagactacgtgaagggccggttcaccatctccagagacaattccaaggacacgctgtatctgcaaatgaacagcctgagagccgaggacacggccgtatattactgtgcgaaagatcgggggaacgagtacgccctgacccactactactactacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5780 - DNA, 642 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatacagtttgcaaagtggggtcccatcaaggttcagtggcggtggatctgggacagatttcactctcaccatcagcagtctgcaacctgaagattttgcaacttacttctgtcaacagagttacagtaccccgatcactttcggccaagggacacgactggagattaaaagaactgtggcggcgccatctgtcttcatcttcccgccatctgatgagcagttgaaatccggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgc

SEQ ID NO: 5781 - DNA, 1350 bp, Homo sapiens
caggtacagctggtggagtctgggggaggcgtggtccagcctgggaggtccctgagactctcctgtgcagcctctggattcaccttcagtagatttactctacactgggtccgccaggctccaggcaaggggctggagtgggtggcagttatatcatatgatggaagcaataaatattacgcagactccgtgaagggccgattcaccatctccagagacaattccaagagcactctctatctgcaaatgaacagcctgagagctgaggacacgggtgtgtattactgtgcgagagatccctctacggtgaccggctactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgcactgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtatgtggacggcgtggaggtgcataatgccaagacaaagccgcgggaggagcagtacaacagcacgtaccgtgtggtcagcgtcctcaccgtcctgcaccaagactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaagtcagcctgacctgcctggtcaaaggcttctatcccagcgacatcgccgtggagtgggagagcaatgggcagccggagaacaactacaagaccacgcctcccgtgctggactccgacggctccttcttcctctattccaagctcaccgtggacaagagcaggtggcagcaggggaacgtcttctcatgctccgtgatgcatgaggctctgcacaaccactacacgcagaagagcctctccctgtctccgggcaaa

SEQ ID NO: 5782 - DNA, 633 bp, Homo sapiens
tcctatgtgctgactcagccaccctcagtgtcagtggccccaggaaagacggccaagatttcctgtgggggagacagcattggaagtaaaagtgtccactggtaccagcagaagccaggccaggcccctgtgctggtcatctattatgataacgaccggccctcagggatccctgagcgattctctggctccaactctgggaacacggccaccctgaccatcagcagggtcgaagccggggatgaggccgactattactgtcaggtgtgggatattggtgtggtattcggcggagggaccaagctgaccgtcctaggccagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagacaaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

What is claimed is:

1. An antibody that specifically binds to a SARS-CoV-2 spike protein, wherein the antibody comprises three CDRs of a heavy chain variable region (VH) set forth as SEQ ID NO: 4949 and three CDRs of a light chain variable region (VL) set forth as SEQ ID NO: 4950, wherein the antibody has an IgG1m3 allotype.

2. The antibody of claim 1, wherein the antibody comprises:
   (a) CDR-H1 comprising residues 31-35 of the VH, CDR-H2 comprising residues 50-65 of the VH, and CDR-H3 comprising residues 95-102 of the VH; and
   (b) CDR-L1 comprising residues 24-34 of VL, CDR-L2 comprising residues 50-56 of the VL, and CDR-L3 comprising residues 89-97 of the VL; and
   wherein the CDR numbering is according to Kabat.

3. The antibody of claim 1, wherein the antibody comprises:
   (a) CDR-H1 comprising residues 26-32 of the VH, CDR-H2 comprising residues 50-58 of the VH, and CDR-H3 comprising residues 95-102 of the VH; and
   (b) CDR-L1 comprising residues 24-34 of the VL, CDR-L2 comprising residues 50-56 of the VL, and CDR-L3 comprising residues 89-97 of the VL; and
   wherein the CDR numbering is according to Chothia.

4. The antibody of claim 1, wherein the antibody comprises:
   (a) CDR-H1 comprising residues 30-35 of the VH, CDR-H2 comprising residues 47-58 of the VH, and CDR-H3 comprising residues 93-101 of the VH; and
   (b) CDR-L1 comprising residues 30-36 of the VL, CDR-L2 comprising residues 46-55 of the VL, and CDR-L3 comprising the residues 89-96 of the VL; and
   wherein the CDR numbering is according to MacCallum.

5. The antibody of claim 1, wherein the antibody comprises a heavy chain variable region set forth as SEQ ID NO: 4949 and a light chain variable region set forth as SEQ ID NO: 4950.

6. An antibody comprising a heavy chain comprising SEQ ID NO: 5735 and a light chain comprising SEQ ID NO: 5736.

7. A pharmaceutical composition comprising the antibody of claim 6, and one or more pharmaceutically acceptable carriers, diluents, or excipients.

8. The pharmaceutical composition of claim 7, wherein the pharmaceutical composition comprises at least one additional antibody that binds the SARS-CoV-2 spike protein.

9. The pharmaceutical composition of claim 7, wherein the pharmaceutical composition further comprises histidine, sodium chloride, sucrose, and polysorbate 80.

10. The pharmaceutical composition of claim 7, wherein the pharmaceutical composition has a pH of about 6.0.

11. The pharmaceutical composition of claim 7, wherein the pharmaceutical composition comprises 5 mM histidine, 50 mM NaCl, 6% sucrose, and 0.05% polysorbate 80 and has a pH of about 6.0.

12. The pharmaceutical composition of claim 7, wherein the antibody concentration in the pharmaceutical composition is about 35 mg/mL to about 125 mg/mL.

13. A method of treating a SARS-CoV-2-linked disease comprising administering to a patient a therapeutically effective amount of the antibody of claim 6.

14. A method of treating COVID-19 comprising administering to a patient a therapeutically effective amount of the antibody of claim 6.

15. The method of claim 14, wherein the antibody is administered to the patient intravenously or subcutaneously at about 35 mg to about 7000 mg.

16. The method of claim 14, wherein the method further comprises administering to the patient another antibody that binds the SARS-CoV-2 spike protein.

17. The antibody of claim 1, wherein the antibody neutralizes SARS-CoV-2.

18. The antibody of claim 1, which is conjugated to an immunomodulator, a cytokine, a cytotoxic agent, a chemotherapeutic agent, a diagnostic agent, an antiviral agent, an antimicrobial agent, or a drug.

19. A pharmaceutical composition comprising the antibody of claim 1, and one or more pharmaceutically acceptable carriers, diluents, or excipients.

20. The pharmaceutical composition of claim 19, wherein the pharmaceutical composition comprises at least one additional antibody that binds the SARS-CoV-2 spike protein.

21. The pharmaceutical composition of claim 19, wherein the pharmaceutical composition further comprises histidine, sodium chloride, sucrose, and polysorbate 80.

22. The pharmaceutical composition of claim 19, wherein the pharmaceutical composition has a pH of about 6.0.

23. The pharmaceutical composition of claim 19, wherein the pharmaceutical composition comprises 5 mM histidine, 50 mM NaCl, 6% sucrose, and 0.05% polysorbate 80 and has a pH of about 6.0.

24. The pharmaceutical composition of claim 19, wherein the antibody concentration in the pharmaceutical composition is about 35 mg/mL to about 125 mg/mL.

25. A method of treating a SARS-CoV-2-linked disease comprising administering to a patient a therapeutically effective amount of the antibody of claim 1.

26. A method of treating COVID-19 comprising administering to a patient a therapeutically effective amount of the antibody of claim 1.

* * * * *

UNITED STATES PATENT AND TRADEMARK OFFICE
CERTIFICATE OF CORRECTION

PATENT NO. : 11,447,541 B1
APPLICATION NO. : 17/354476
DATED : September 20, 2022
INVENTOR(S) : Kathryn Westendorf et al.

It is certified that error appears in the above-identified patent and that said Letters Patent is hereby corrected as shown below:

On the Title Page

Item (71) Applicants Line 1: the Applicant's name should be changed to "AbCellera Biologies Inc."

Item (73) Assignees Line 1: the Assignee's name should be changed to "AbCellera Biologies Inc."

Signed and Sealed this
First Day of November, 2022

*Katherine Kelly Vidal*

Katherine Kelly Vidal
*Director of the United States Patent and Trademark Office*